(12) United States Patent
Edwards et al.

(10) Patent No.: US 11,312,771 B2
(45) Date of Patent: Apr. 26, 2022

(54) SINGLE-DOMAIN ANTIBODIES TO PROGRAMMED CELL DEATH 1 PROTEIN (PD-1), ENCODING NUCLEIC ACIDS AND METHODS OF USING SAME

(71) Applicant: CRESCENDO BIOLOGICS LIMITED, Cambridge (GB)

(72) Inventors: Carolyn Edwards, Cambridge (GB); James Legg, Cambridge (GB); Martyna Lewandowska, Cambridge (GB); Colette Johnston, Cambridge (GB); Christine Rossant, Cambridge (GB); Yumin Teng, Cambridge (GB)

(73) Assignee: CRESCENDO BIOLOGICS LIMITED, Cambridge (GB)

( * ) Notice: Subject to any disclaimer, the term of this patent is extended or adjusted under 35 U.S.C. 154(b) by 97 days.

(21) Appl. No.: 16/475,599

(22) PCT Filed: Jan. 8, 2018

(86) PCT No.: PCT/GB2018/050037
§ 371 (c)(1),
(2) Date: Jul. 2, 2019

(87) PCT Pub. No.: WO2018/127711
PCT Pub. Date: Jul. 12, 2018

(65) Prior Publication Data
US 2019/0322749 A1    Oct. 24, 2019

(30) Foreign Application Priority Data

Jan. 6, 2017 (GB) .................................. 1700207
Jan. 6, 2017 (GB) .................................. 1700208
Jan. 6, 2017 (GB) .................................. 1700210

(51) Int. Cl.
| | | |
|---|---|---|
| C12N 15/85 | (2006.01) | |
| G01N 33/68 | (2006.01) | |
| C07K 16/28 | (2006.01) | |
| A61P 35/00 | (2006.01) | |
| A01K 67/027 | (2006.01) | |
| A61K 39/00 | (2006.01) | |
| C07K 16/18 | (2006.01) | |

(52) U.S. Cl.
CPC ...... *C07K 16/2818* (2013.01); *A01K 67/0278* (2013.01); *A61P 35/00* (2018.01); *C07K 16/2803* (2013.01); *C12N 15/85* (2013.01); *G01N 33/6803* (2013.01); *A01K 2227/105* (2013.01); *A61K 2039/505* (2013.01); *C07K 16/18* (2013.01); *C07K 2317/24* (2013.01); *C07K 2317/31* (2013.01); *C07K 2317/33* (2013.01); *C07K 2317/35* (2013.01); *C07K 2317/565* (2013.01); *C07K 2317/569* (2013.01); *C07K 2317/70* (2013.01); *C07K 2317/76* (2013.01); *C07K 2317/92* (2013.01); *C07K 2317/94* (2013.01); *C07K 2319/00* (2013.01)

(58) Field of Classification Search
CPC ............ C07K 16/2818; C07K 2317/33; C07K 2317/569; C07K 2317/76; C07K 2317/92; C07K 2317/94; C12N 15/85
See application file for complete search history.

(56) References Cited

U.S. PATENT DOCUMENTS

| | | |
|---|---|---|
| 7,851,598 B2 | 12/2010 | Davis et al. |
| 10,202,458 B2 * | 2/2019 | Goetsch ............. A61K 47/6851 |
| 2010/0122358 A1 | 5/2010 | Bruggemann et al. |
| 2013/0202623 A1 | 8/2013 | Chomont et al. |
| 2015/0210769 A1 | 7/2015 | Freeman et al. |
| 2015/0210796 A1 | 7/2015 | Kim et al. |
| 2017/0240644 A1 | 8/2017 | Zhou et al. |
| 2018/0362666 A1 | 12/2018 | Teng et al. |
| 2019/0322749 A1 | 10/2019 | Edwards et al. |
| 2020/0239570 A1 | 7/2020 | Edwards et al. |
| 2020/0239573 A1 | 7/2020 | Hayes et al. |
| 2021/0015937 A1 | 1/2021 | Edwards et al. |

FOREIGN PATENT DOCUMENTS

| | | |
|---|---|---|
| WO | WO-2003000737 A2 | 1/2003 |
| WO | WO-2004076618 A2 | 9/2004 |
| WO | WO 2009/117335 | 9/2009 |
| WO | WO-2009114335 A2 | 9/2009 |
| WO | WO-2010036959 A2 | 4/2010 |
| WO | WO 2011/110621 | 9/2011 |
| WO | WO-2014141192 A1 | 9/2014 |
| WO | WO-2015112900 A1 | 7/2015 |
| WO | WO-2015116539 A1 | 8/2015 |
| WO | WO-2015200119 A1 | 12/2015 |
| WO | WO 2016/020856 | 2/2016 |
| WO | WO-2016062990 A1 | 4/2016 |
| WO | WO-2016073760 A1 | 5/2016 |
| WO | WO 2016/106159 | 6/2016 |
| WO | WO-2016197497 A1 | 12/2016 |

(Continued)

OTHER PUBLICATIONS

Paul, WE (1993) Fundamental Immunology, 3rd ed. Raven Press, NY, Chap. 9, pp. 292-295.*
Rudikoff, S et al. (1982) Proc. Natl. Acad. Sci. USA, 79:1979-1983.*
Colman, PM (1994) Research in Immunology, Elsevier, NY, 145(1):33-36.*
Geng, Yu, et al., "2$^{nd}$ International Conference on Antibodies and Therapeutics." Jul. 11-12, 2016, Philadelphia, USA.
Caldas, C., et al., "Humanization of the anti-CD18 antibody 6.7: an unexpected effect of a framework residue in binding to antigen," *Molecular Immunology* 39(15):941-952, Elsevier, Netherlands (May 2003).

(Continued)

*Primary Examiner* — Robert S Landsman
(74) *Attorney, Agent, or Firm* — Sterne, Kessler, Goldstein & Fox P.L.L.C.

(57) ABSTRACT

The invention relates to multifunctional PD-1 binding agents and the use of such binding agents in the treatment, prevention and detection of disease.

16 Claims, 9 Drawing Sheets

Figure 1:
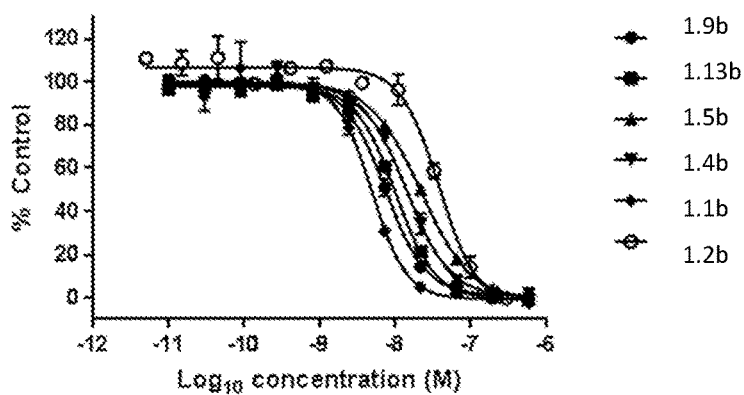
Figure 1:
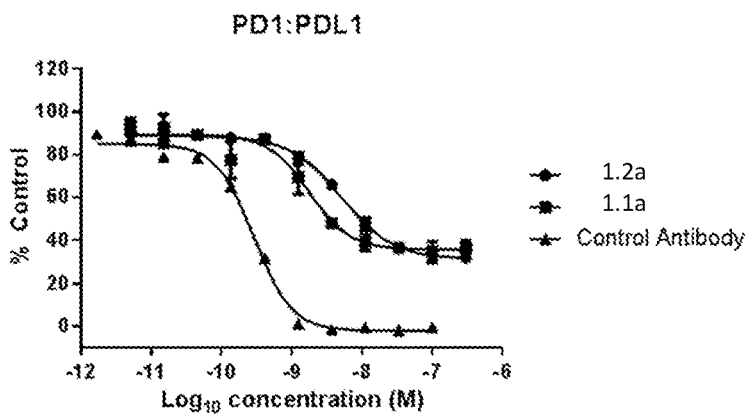
Figure 1:
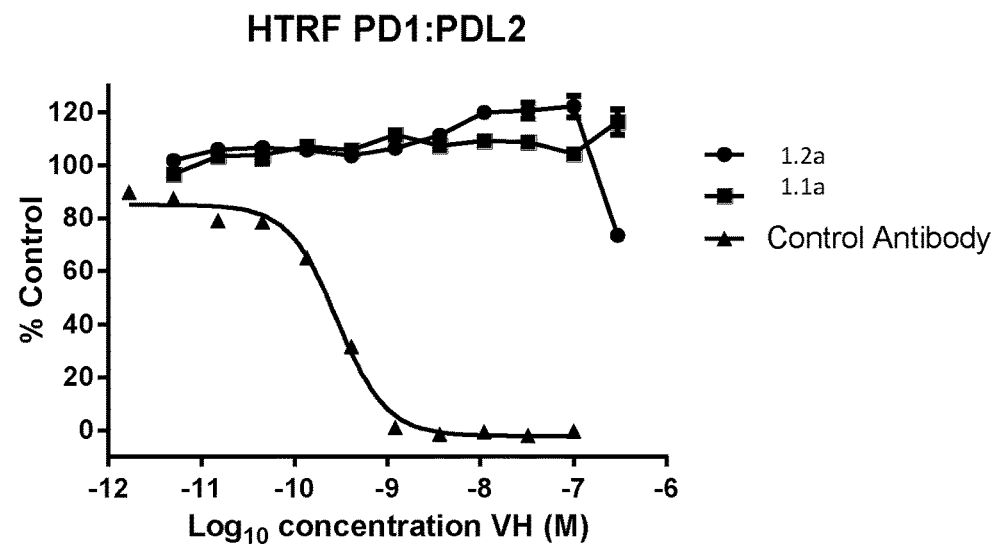

Specification includes a Sequence Listing.

(56) References Cited

FOREIGN PATENT DOCUMENTS

| WO | WO-2017019846 A1 | 2/2017 | |
| WO | WO-2017020801 A * | 2/2017 | ............ C12N 15/85 |
| WO | WO-2017087589 A2 | 5/2017 | |
| WO | WO-2018127709 A1 | 7/2018 | |
| WO | WO-2018127710 A1 | 7/2018 | |
| WO | WO-2018127711 A1 | 7/2018 | |
| WO | WO-2019158942 A1 | 8/2019 | |
| WO | WO-2020229844 A1 | 11/2020 | |

OTHER PUBLICATIONS

Du, J., et al., "Molecular basis of recognition of human osteopontin by 23C3, a potential therapeutic antibody for treatment of rheumatoid arthritis," Journal of Molecular Biology 382(4):835-842, Elsevier, Netherlands (published online Jul. 2008, published in print Oct. 2008).

Kunik, V., et al., "Structural consensus among antibodies defines the antigen binding site," PLoS Comput Biol 8(2):e1002388, 12 pages, Public Library of Science, United States (published online Feb. 2012).

Agata, Y., "Expression of the PD-1 antigen on the surface of stimulated mouse T and B lymphocytes," Int. Immunology, 8(5):765-772, Oxford University Press, United Kingdom (May 1996).

Bennett, F., et al., "Program Death-1 Engagement Upon TCR Activation Has Distinct Effects on Costimulation and Cytokine-Driven Proliferation: Attenuation of ICOS, IL-4, and IL-21, But Not CD28, IL-7, and IL-15 Responses," Journal of Immunology 170(2):711-718, The American Association of Immunologists, Inc., United States (2003).

Bruschi, C.V., and Gjuracic, K., "Yeast Artifical Chromosomes" in the Encyclopedia of Life Sciences, pp. 1-6, Macmillan Publishers Ltd., United Kingdom (2002).

Callahan, M.K., and Wolchok, J.D., "At the bedside: CTLA-4- and PD-1-blocking antibodies in cancer immunotherapy," J Leukoc Biol 94(1):41-53, Society for Leukocyte Biology, United States (2013).

Castelli, C., et al., "Lymphocyte activation gene-3 (LAG-3, CD223) in plasmacytoid dendritic cells (pDCs): a molecular target for the restoration of active antitumor immunity," Oncoimmunology, 3(11):e967146, 4 pages, Landes Bioscience, United States (Dec. 2014).

Dietz, L.J., et al., "Volumetric capillary cytometry: a new method for absolute cell enumeration," Cytometry 23(3):177-186, John Wiley & Sons, United States (1996).

D'huyvetter, M., et al., "Radiolabeled nanobodies as theranostic tools in targeted radionuclide therapy of cancer," Expert Opin. Drug Deliv., 11(12):1939-54, Taylor and Francis Ltd., United Kingdom (Dec. 2014).

Francisco, L., et al., "The PD-1 pathway in tolerance and autoimmunity," Immunol. Rev., 236:219-242, Wiley-Blackwell Publishing Ltd., United Kingdom (Jul. 2010).

Genbank, "Alpha-synuclein," Accession No. P37840.1, accessed at https://www.ncbi.nlm.nih.gov/protein/P37840, accessed on Sep. 24, 2020, 13 pages.

Genbank, "C-type lectin domain family 4 member G isoform 1 [Homo sapiens]," Accession No. NP_940894.1, accessed at https://www.ncbi.nlm.nih.gov/protein/NP_940894, accessed on Sep. 24, 2020, 3 pages.

Genbank, "E3 ubiquitin-protein ligase CBL-B isoform b [Homo sapiens]," Accession No. NP_001308717.1, accessed at https://www.ncbi.nlm.nih.gov/protein/NP_001308717, accessed on Sep. 24, 2020, 4 pages.

Genbank, "galectin-3 [Homo Sapiens]," Accession No. BAA22164.1, accessed at https://www.ncbi.nlm.nih.gov/protein/BAA22164, accessed on Sep. 24, 2020, 2 pages.

Genbank, "Homo sapiens lymphocyte activating 3 (LAG3), mRNA," Accession No. NM_002286.6, accessed at https://www.ncbi.nlm.nih.gov/nuccore/NM_002286, accessed on Sep. 24, 2020, 5 pages.

Genbank, "Human hPD-1 (hPD-1) mRNA, complete cds," Accession No. U64863.1, accessed at https://www.ncbi.nlm.nih.gov/nuccore/U64863, accessed on Sep. 24, 2020, 3 pages.

Genbank, "Macaca fascicularis chromosome 11,Macaca_fascicularis 5.0, whole genome shotgun sequence," Accession No. NC_022282.1, accessed at https://www.ncbi.nlm.nih.gov/nuccore/NC_022282, accessed on Sep. 24, 2020, 2 pages.

Genbank, "Macaca mulatta lymphocyte activating 3 (LAG3), mRNA," Accession No. XM_001108923.4, accessed at https://www.ncbi.nlm.nih.gov/nuccore/XM_001108923, accessed on Sep. 24, 2020, 2 pages.

Grosso, J., et al., "LAG-3 regulates CD8+ T cell accumulation and effector function in murine self- and tumor-tolerance systems," J. Clin. Invest., 117(11):3383-92, American Society for Clinical Investigation, United States (Nov. 2007).

He, J., et al., "Development of PD-1/PD-L1 Pathway in Tumor Immune Microenvironment and Treatment for Non-Small Cell Lung Cancer," Scientific Reports 5:13110, 9 pages, Nature Publishing Group, United Kingdom (2015).

Holt, L., et al., "Domain antibodies: proteins for therapy," Trends Biotechnol., 21(11):484-90, Elsevier Ltd., Netherlands (Nov. 2003).

Huang, C., et al., "Role of LAG-3 in regulatory T cells," Immunity, 21(4):503-13, Cell Press, United States (Oct. 2004).

Huang, R., et al., "Compensatory upregulation of PD-1, LAG-3, and CTLA-4 limits the efficacy of single-agent checkpoint blockade in metastatic ovarian cancer," Oncoimmunol. 6(1):e1249561, 13 pages, Taylor and Francis Group, United Kingdom (Oct. 2016).

Huard, B., et al., "Characterization of the major histocompatibility complex class II binding site on LAG-3 protein," Proc. Natl. Acad. Sci., 94(11):5744-5749, National Academy of Sciences, United States (May 1997).

Huard, B., et al., "Lymphocyte-activation gene 3/major histocompatibility complex class II interaction modulates the antigenic response of CD4+ T lymphocytes," Eur. J. Immunol., 24(12):3216-21, Wiley-VCH Verlag, Germany (Dec. 1994).

Huard, B., et al., "T cell major histocompatibility complex class II molecules down-regulate CD4+ T cell clone responses following LAG-3 binding," Eur. J. Immunol., 26(5): 1180-6, Wiley-VCH Verlag, Germany (May 1996).

International Preliminary Report on Patentability of the International Searching Authority directed to related International Patent Application No. PCT/GB2018/050035, dated Jul. 9, 2019, 11 pages.

International Preliminary Report on Patentability of the International Searching Authority directed to related International Patent Application No. PCT/GB2018/050036, dated Jul. 9, 2019, 11 pages.

International Preliminary Report on Patentability of the International Searching Authority directed to related International Patent Application No. PCT/GB2018/050037, dated Jul. 9, 2019, 12 pages.

International Preliminary Report on Patentability of the International Searching Authority directed to related International Patent Application No. PCT/GB2019/050425, dated Aug. 18, 2020, 7 pages.

International Search Report and Written Opinion of the International Searching Authority directed to related International Patent Application No. PCT/GB2018/050035, dated Apr. 25, 2018, 16 pages.

International Search Report and Written Opinion of the International Searching Authority directed to related International Patent Application No. PCT/GB2018/050036, dated May 3, 2018, 16 pages.

International Search Report and Written Opinion of the International Searching Authority directed to related International Patent Application No. PCT/GB2018/050037, dated Apr. 25, 2018, 18 pages.

International Search Report and Written Opinion of the International Searching Authority directed to related International Patent Application No. PCT/GB2019/050425, dated Apr. 17, 2019; 10 pages.

Ishida, Y., et al., "Induced expression of PD-1, a novel member of the immunoglobulin gene superfamily, upon programmed cell death," Embo J., 11(11): 3887-3895, Nature Publishing Group on behalf of the European Molecular Biology Organization, United Kingdom (Nov. 1992).

(56) References Cited

OTHER PUBLICATIONS

Karwacz, K., et al., "PD-L1 co-stimulation contributes to ligand-induced T cell receptor down-modulation on CD8+ T cells," EMBO Mol. Med., 3(10): 581-592, Nature Publishing Group on behalf of the European Molecular Biology Organization, United Kingdom (Oct. 2011).
Keir, M.E., et al., "Programmed death-1 (PD-1):PD-ligand 1 interactions inhibit TCR-mediated positive selection of thymocytes," J Immunol 175(11):7372-7379, The American Association of Immunologists, Inc., United States (2005).
Kisielow, M., et al., "Expression of lymphocyte activation gene 3 (LAG-3) on B cells is induced by T cells," Eur. J. Immunol., 35(7):2081-8, Wiley-VCH Verlag, Germany (Jul. 2005).
Kouo, T., et al., "Galectin-3 Shapes Antitumor Immune Responses by Suppressing CD8+ T Cells via LAG-3 and Inhibiting Expansion of Plasmacytoid Dendritic Cells," Cancer Immunol. Res., 3(4):412-423, American Association for Cancer Research Inc., United States (Apr. 2015).
Kraman, M., et al., "A LAG-3/PD-L1 bispecific antibody inhibits tumor growth in two syngeneic colon carcinoma models," Society for Immunotherapy of Cancer (SITC) Conference, BioMed Central Ltd., United Kingdom (Nov. 2016).
Lowther, D.E., et al., "PD-1 marks dysfunctional regulatory T cells in malignant gliomas," JCI Insight 1(5):e85935, 15 pages, The American Society for Clinical Investigation, United States (2016).
Main, S., et al., "A potent human anti-eotaxinl antibody, CAT-213: isolation by phage display and in vitro and in vivo efficacy," J Pharmacol Exp Ther 319(3):1395-404, American Society for Pharmacology and Experimental Therapeutics, United States (2006).
Marks, J.D., and Bradbury, A., "Chapter 8: Selection of Human Antibodies from Phage Display Libraries" in Methods in Molecular Biology, Antibody Engineering: Methods and Protocols, Lo, B., ed., pp. 161-176, Springer Nature, Switzerland (2004).
Marks, J.D., "Chapter 19: Antibody Affinity Maturation by Chain Shuffling" in Methods in Molecular Biology, Antibody Engineering: Methods and Protocols, Lo, B., ed., pp. 327-343, Springer Nature, Switzerland (2004).
Matsuzaki, J., et al., "Tumor-infiltrating NY-ESO-1-specific CD8+ T cells are negatively regulated by LAG-3 andPD-1 in human ovarian cancer," Proc. Natl. Acad. Sci., 107(17):7875-7880, National Academy of Science, United States (Apr. 2010).
McGuinness, B., "Humabody fragments: Small and perfectly formed," Biopharmadealmakers, accessed at www.crescendobiologics.com, pp. B12-B13, 2 pages (2013).
Miraglia, S., et al., "Homogeneous Cell- and Bead-Based Assays for High Throughput Screening Using Fluorometric Microvolume Assay Technology," J Biomol Screening 4(4):193-204, SAGE Journals, United States (1999).
NCT02061761, "Safety Study of Anti-LAG-3 in Relapsed or Refractory Hematologic Malignancies," ClinicalTrials.gov, posted Feb. 13, 2014, accessed at https://www.clinicaltrials.gov/ct2/show/NCT02061761 on Dec. 14, 2020, 4 pages.
NCT02460224, "Safety and Efficacy of LAG525 Single Agent and in Combination With PDR001 in Patients With Advanced Malignancies," ClinicalTrials.gov, posted Jun. 2, 2015, accessed at https://www.clinicaltrials.gov/ct2/show/NCT02460224 on Dec. 14, 2020, 5 pages.
Nishimura, H., et al., "Autoimmune dilated cardiomyopathy in PD-1 receptor-deficient mice," Science, 291(5502):319-322, American Association for the Advancement of Science, United States (Jan. 2001).
Nishimura, H., et al., "Development of lupus-like autoimmune diseases by disruption of the PD-1 gene encoding an ITIM motif-carrying immunoreceptor," Immunity, 11(2):141-151, Cell Press, United States (Aug. 1999).
Posthumus, W.P., et al., "Analysis and simulation of a neutralizing epitope of transmissible gastroenteritis virus," J Virology 64(7):3304-3309, American Society for Microbiology, United States (1990).

Ren, L., et al., "Silencing of the immunoglobulin heavy chain locus by removal of all eight constant-region genes in a 200-kb region," Genomics, 84(4):686-695, Academic Press Inc., United States (Oct. 2004).
Riley, J., "PD-1 signaling in primary T cells," Immunol Rev., 229(1):114-125, Wiley-Blackwell Publishing Ltd., United Kingdom (May 2009).
Roe, M., "Superior Human Single Domain VH Antibody Fragments from a Transgenic Mouse," Biopharmadealmakers, accessed at www.crescendobiologics.com, p. B23, 1 page (2013).
Rudikoff, S., et al., "Single Amino Acid Substitution Altering Antigen-Binding Specificity," Proc. Natl. Acad. Sci., 79(6):1979-1983, National Academy of Science, United States (Mar. 1982).
Triebel, F., et al., "LAG-3, a novel lymphocyte activation gene closely related to CD4," J. Exp. Med., 171(5):1393-1405, Rockefeller University Press, United States (May 1990).
Tseng, S., et al., "B7-DC, a new dendritic cell molecule with potent costimulatory properties for T cells," J. Exp. Med., 193(7):839-45, Rockefeller University Press, United States (Apr. 2001).
UK Search Report for Application No. GB1700207.2, dated Nov. 24, 2017; 4 pages.
UniParc, "UPI0000119BF0," accessed at https://www.uniprot.org/uniparc/UPI0000119BF0, accessed on Sep. 24, 2020, 1 page.
UniProt, "E3 ubiquitin-protein ligase CBL," Accession No. P22681, accessed at https://www.uniprot.org/uniprot/P22681, accessed on Sep. 24, 2020, 10 pages.
UniProt, "E3 ubiquitin-protein ligase CBL-B," Accession No. Q13191, accessed at https://www.uniprot.org/uniprot/Q13191, accessed on Sep. 24, 2020, 10 pages.
Uniprot, "Programmed cell death protein 1," Accession No. Q15116, accessed at https://www.uniprot.org/uniprot/Q15116, accessed on Sep. 24, 2020, 7 pages.
Wang, C., et al., "In vitro characterization of the anti-PD-1 antibody nivolumab, BMS-936558, and in vivo toxicology in non-human primates," Cancer Immunol Res 2(9):846-856, American Association for Cancer Research, United States (2014).
Wang, W., et al., "PD1 blockade reverses the suppression of melanoma antigen-specific CTL by CD4+ CD25$^{Hi}$ regulatory T cells," Int Immunol 21(9):1065-1077, Oxford University Press, United Kingdom (2009).
Wesolowski, J., et al., "Single domain antibodies: promising experimental and therapeutic tools in infection and immunity," Medical Microbiology and Immunology, 198(3)157-174, Springer Verlag, Germany (Aug. 2009).
Wong, Y., et al., "Structural Requirements for a Specificity Switch and for Maintenance of Affinity Using Mutational Analysis of a Phase-Displayed Anti-Arsonate Antibody of Fab Heavy Chain First Complementarily-Determining Region," J. Immunol., 160(12):5990-7, American Association of Immunologists, United States (Jun. 1998).
Workman, C., et al., "Cutting edge: molecular analysis of the negative regulatory function of lymphocyte activation gene-3," J. Immunol., 169(10):5392-5395, American Association of Immunologists, United States (Nov. 2002).
Xu, F., et al., "LSECtin expressed on melanoma cells promotes tumor progression by inhibiting antitumor T-cell responses," Cancer Res., 74(13):3418-3428, American Association for Cancer Research, United States (Jul. 2014).
Yokosuka, T., et al., "Programmed cell death 1 forms negative costimulatory microclusters that directly inhibit T cell receptor signaling by recruiting phosphatase SHP2," J. Exp. Med., 209(6):1201-1217, Rockefeller University Press, United States (Jun. 2012).
Zhang, X., et al., "Structural and functional analysis of the costimulatory receptor programmed death-1," Immunity, 20(3):337-347, Cell Press, United States (Mar. 2004).
Zou, X., et al., "Block in development at the pre-B-II to immature B cell stage in mice without Ig kappa and Ig lambda light chain," J. Immunol., 170(3):1354-61, American Association of Immunologists, United States (Feb. 2003).
Goel, Manisha, et al. "Plasticity within the antigen-combining site may manifest as molecular mimicry in the humoral immune response." The Journal of Immunology 173(12): 7358-7367, American Association of Immunology, United States (2004).

(56) References Cited

OTHER PUBLICATIONS

Lloyd, C., et al. "Modelling the human immune response: performance of a $10^{11}$ human antibody repertoire against a broad panel of therapeutically relevant antigens." Protein Engineering, Design & Selection 22(3): 159-168, Oxford University Press, England (2009).
Edwards, Bryan M., et al. "The remarkable flexibility of the human antibody repertoire; isolation of over one thousand different antibodies to a single protein, BLyS." Journal of Molecular Biology 334(1): 103-118, Elsevier, Netherlands (2003).
Padlan, Eduardo A. "X-ray crystallography of antibodies." Advances in Protein Chemistry 49: 57-133, Academic Press, United States (1996).
Berglund, Lisa, et al. "The epitope space of the human proteome." Protein Science 17(4): 606-613, John Wiley, United States (2008).
Tzartos, Socrates J. "Epitope mapping by antibody competition." Epitope Mapping Protocols: in Methods in Molecular Biology, 66:55-66, Humana Press, United States (1996).
Chen, Longxin, et al. "Epitope-directed antibody selection by site-specific photocrosslinking." Science Advances 6(14): eaaz7825, 9 pages, American Association for the Advancement of Science, United States (2020).
Muyldermans, Serge, "Nanobodies: natural single-domain antibodies." Annual Review of Biochemistry 82: 17.1-17.23, 23 pages, Annual Reviews, United States (2013).
Zabetakis, Dan, et al. "Contributions of the complementarity determining regions to the thermal stability of a single-domain antibody." PloS one 8(10): e77678, 7 pages, Public Library of Science, United States (2013).
Vincke, Cecile, et al. "General strategy to humanize a camelid single-domain antibody and identification of a universal humanized nanobody scaffold." Journal of Biological Chemistry 284(5): 3273-3284, American Society for Biochemistry and Molecular Biology, United States (2009).
Saerens, Dirk, et al. "Identification of a universal VHH framework to graft non-canonical antigen-binding loops of camel single-domain antibodies." Journal of molecular biology 352(3): 597-607, Elsevier, Netherlands (2005).
Holt, L.J., et al., "Anti-serum albumin domain antibodies for extending the half-lives of short lived drugs," Protein Eng. Des. Sel. 21(5):283-288, Oxford University Press, United Kingdom (2008).
Gordon, S.R., et al., "PD-1 expression by tumor-associated macrophages inhibits phagocytosis and tumour immunity," Nature 545(7655): 495-499, Nature Publishing Group, United Kingdom (2017).
Legg, J.W., et al., "CB307: A novel T-cell costimulatory Humabody VH therapeutic for PSMA-positive tumors," retrieved from: https://www.crescendobiologics.com/wp-content/uploads/2019/08/20190412-CB307-A-novel-T-cell-costimulatory-Humabody%C2%AE-VH-therapeutic-for-PSMA-positive-tumors.pdf, 1 page, (2019).
Perez-Ruiz, E., et al., "Anti-CD137 and PD-1/PD-L1 Antibodies En Route toward Clinical Synergy," Clinical Cancer Research 23(18):5326-5328, American Cancer Research, United States (2017).
International Search Report and Written Opinion in Application No. PCT/GB2020/051201, E.P.O., Netherlands, dated Oct. 13, 2020, 23 pages.
Office Action dated Sep. 20, 2021, in U.S. Appl. No. 16/475,590, Edwards. et al., 371(c) date: Jul. 2, 2019, 15 pages.
Office Action dated Jun. 30, 2021, in U.S. Appl. No. 16/475,597, Hayes. et al., 371(c) Date: Jul. 2, 2019, 23 pages.
Drabek, D., et al., "Expression Cloning and Production of Human Heavy-Chain-Only Antibodies from Murine Transgenic Plasma Cells," Frontiers in Immunology 7(619): 1-10, Frontiers Media SA, United States (Dec. 2016).
Trinklein, N., et al., "Abstract LB-090: Sequence-based discovery of fully human anti-CD3 and anti-PDL1 single domain antibodies using novel transgenic rats," Cancer Research 76(14): 1-4, American Association of cancer Research, United States (Jul. 2016).

* cited by examiner a)

b)

c)

a)

b)

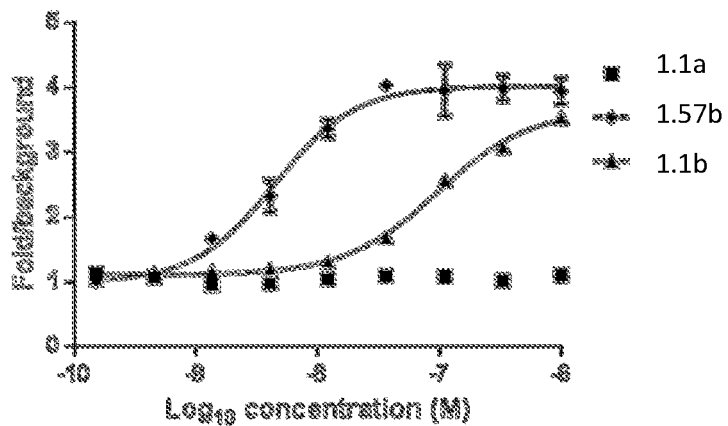
Figure 3
a)
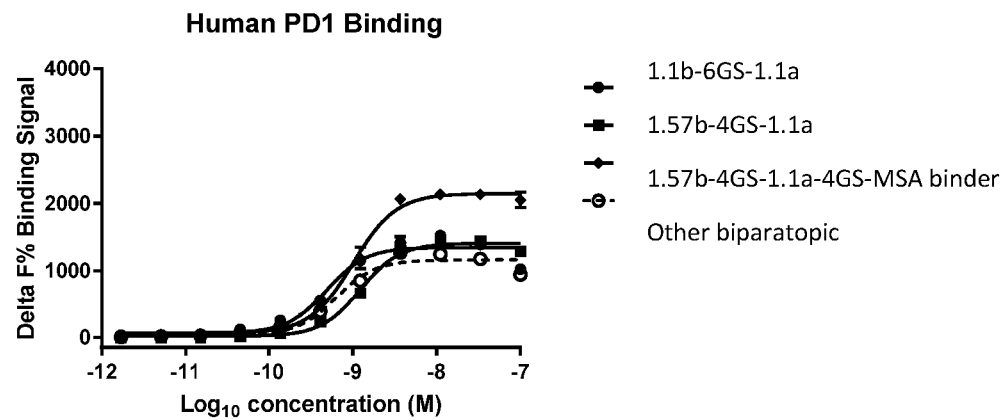
b)
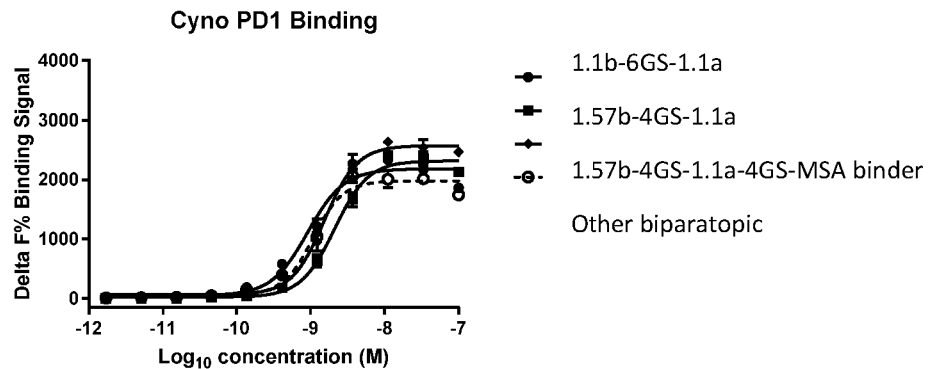
c)

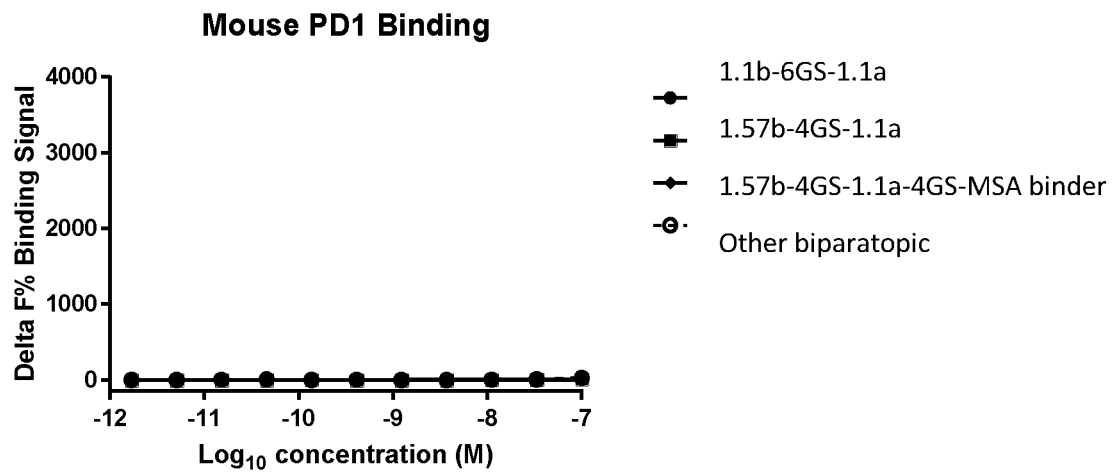
Figure 4
a)
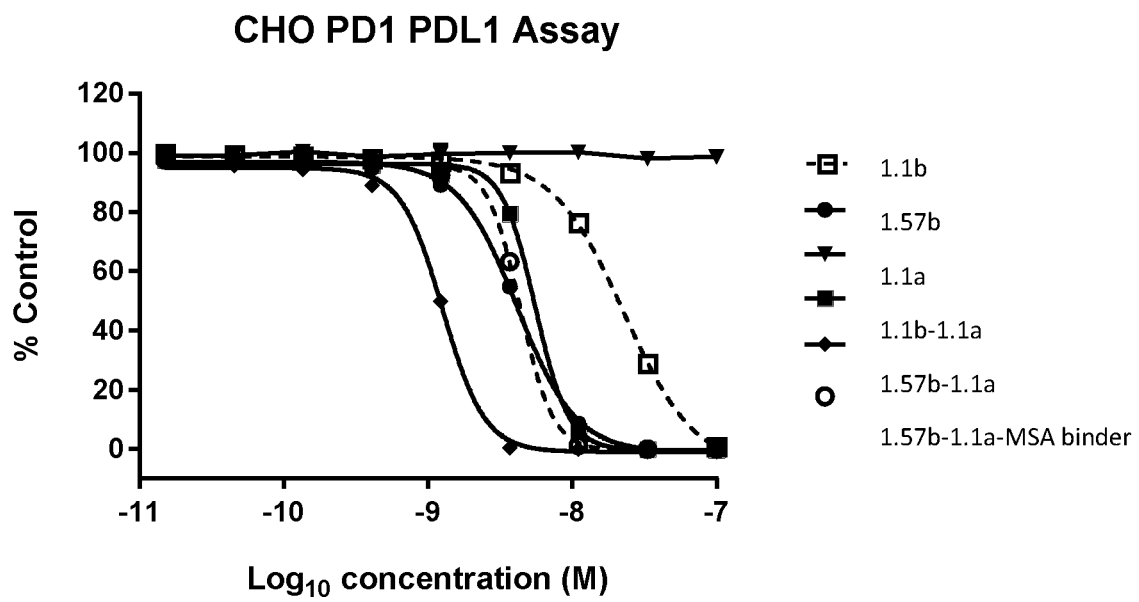

b)

c)

a)

b)

SINGLE-DOMAIN ANTIBODIES TO PROGRAMMED CELL DEATH 1 PROTEIN (PD-1), ENCODING NUCLEIC ACIDS AND METHODS OF USING SAME

CROSS-REFERENCE TO RELATED APPLICATIONS

This application is a 35 U.S.C. § 371 National Phase Application of International Application No. PCT/GB2018/050037, filed Jan. 8, 2018, which claims the benefit of GB Application Nos. 1700207.2, filed Jan. 6, 2017, 1700208.0, filed Jan. 6, 2017, and 1700210.6, filed Jan. 6, 2017, the content of each is incorporated herein by reference in its entirety.

REFERENCE TO A SEQUENCE LISTING SUBMITTED ELECTRONICALLY VIA EFS-WEB

The content of the electronically submitted sequence listing (Name: Sequence Listing .txt; Size: 590,279 bytes; and Date of Recordation: Jul. 2, 2019) is herein incorporated by reference in its entirety.

FIELD OF THE INVENTION

The invention relates to PD-1 binding agents comprising PD-1 binding $V_H$ single domain antibodies (sdAb) and the use of such binding agents in the treatment, prevention and detection of disease.

INTRODUCTION

Antibody-based therapeutics have emerged as important components of therapies for an increasing number of human diseases in such fields as oncology, inflammatory and infectious diseases. Indeed, antibodies are one of the best-selling classes of drugs today; five of the top ten best selling drugs are antibodies.

The Programmed Death 1 (PD-1) protein is encoded by the PDCD1 gene and expressed as a 55 kDa type I transmembrane protein (Agata 1996 Int Immunol 8(5):765-72). PD-1 is an immunoglobulin superfamily member (Ishida 1992 EMBO 11(11):3887-95) and it is an inhibitory member of the extended CD28/CTLA-4 family of T cell regulators. Other members of this family include CD28, CTLA-4, ICOS and BTLA. PD-1 exists as a monomer, lacking the unpaired cysteine residue characteristic of other CD28 family members (Zhang 2004 Immunity 20:337-47). Its cytoplasmic domain contains an immunoreceptor tyrosine-based inhibitory motif (ITIM) and an immunoreceptor tyrosine-based switch motif (ITSM) that are phosphorylated during signal transduction (Riley 2009 Immunol Rev 229(1):114-25).

PD-1 is expressed on B cells, T cells, and monocytes (Agata 1996). The role of PD-1 in maintaining immunologic self-tolerance was demonstrated in PDCD1-/- mice, which develop autoimmune disorders (Nishimura 1999 Immunity 11:141-51, Nishimura 2001 Science 291(5502):319-22). The PD-1 pathway therefore regulates antigen responses, balancing autoimmunity and tolerance.

There are two ligands for PD-1 that mediate its regulatory function. PD-L1 (B7-H1) is normally expressed on dendritic cells, macrophages, resting B cells, bone marrow-derived mast cells and T cells as well as non-hematopoietic cell lineages (reviewed in Francisco 2010 Immunol Rev 236: 219-42). PD-L2 (B7-DC) is largely expressed on dendritic cells and macrophages (Tseng 2001 J Exp Med 193(7):839-45). Ligand expression is influenced by local mediators and can be upregulated by inflammatory cytokines.

PD-1 is known as an immunoinhibitory protein that negatively regulates TCR signals. The interaction between PD-1 and PD-L1 can act as an immune checkpoint, which can lead to, e.g., a decrease in tumour infiltrating lymphocytes, a decrease in T-cell receptor mediated proliferation, and/or immune evasion by cancerous cells. Immune suppression can be reversed by inhibiting the local interaction of PD-1 with PD-L1 or PD-L2; the effect is additive when the interaction of PD-1 with both PD-L1 and PD-L2 is blocked.

As T cells become activated and co-stimulated by antigen-presenting cells (APCs), T cell expression of PD-1 is induced. PD-1 engagement with ligand on the APC cross-links PD-1 and clusters it into the T cell receptor (TCR) complex within the immunological synapse (Yokosuka 2012 J Exp Med 209(9):1201-17). Within the T cell cytoplasm, PD-1 signalling domains ITIM and ITSM are phosphorylated. This induces Src-homology-2 domain-containing tyrosine phosphatase (SHP1/2) that attenuates various components of the T cell receptor (TCR) signalling. T cell activation is dampened, which leads to a reduction in cytokine response, proliferation and cytolytic activity. This downregulation of T cell function serves to prevent over-stimulation, tolerising cells against weakly immunogenic self-antigen.

The PD-1 pathway can be exploited in cancer or infection, whereby tumours or viruses can evade effective immune recognition and T cells demonstrate an 'exhausted' phenotype. PD-L1 has also been shown to be expressed in many tumour types including urothelial, ovarian, breast, cervical, colon, pancreatic, gastric, melanoma, glioblastoma and non-small cell lung carcinoma (reviewed in Callahan 2014 J Leukoc Biol 94(1):41-53). The cytokines produced by cancer stromal cells can further upregulate PD-L1 in the tumour microenvironment (He 2015 Nature Scientific Reports 5:13110). As a result, tumour-specific T cells become unresponsive through PD-1 signalling and therefore fail to eliminate their target. T regulatory cells (T regs) have also been shown to express high levels of PD-1 and they suppress the anti-tumour response further (Lowther 2016 JCI Insight 1(5):85935).

Disruption of the PD-1:PD-L1 interaction enhances T cell activity. An anti-PD-1 monoclonal antibody demonstrates blockade of the interaction between PD-1 and its ligands (Wang 2014 Cancer Immunol Res 2(9):846-56). T cell function in-vitro can be enhanced by PD-1 blockade, as demonstrated by improved proliferation and cytokine responses in mixed lymphocyte reactions of T cells and dendritic cells. Cytotoxic lymphocytes (CTLs) derived from melanoma patients has also been shown to be enhanced by PD-1 blockade in vitro using the antibody OPDIVO® (nivolumab), and can become resistant to Treg suppression (Wang 2009 Int Immunol 21(9): 1065-1077). This antibody has been tested in clinical dose escalation studies in melanoma, non-small cell lung carcinoma (NSCLC), renal cell cancer (RCC) and others. It shows improved overall survival rates compared to chemotherapy in NSCLC patients. Another PD-1 blocking antibody, KEYTRUDA® (pembrolizumab), demonstrates responses in NSCLC patients refractory to CTLA-4 blockade. OPDIVO® (nivolumab) and KEYTRUDA® (pembrolizumab) both functionally block the interaction of human PD-1 with its ligands.

It is possible to induce PD-1 signalling by cross-linking it on the membrane with a combination of anti-PD-1 plus anti-CD3 antibodies (Bennett 2003 J Immunol 170:711-18, Keir 2005 J Immunol 175:7372-7379). This function could be detrimental during an anti-tumour response because T cell activity would be suppressed. If suppression of T cell responses were desired, agonistic anti-PD-1 antibodies or those with effector functions could be used to treat immune-related diseases such as rheumatoid arthritis.

The aim of the present invention is to address the need of alternative antibody-based treatments for use in the treatment of disease, in particular in the treatment of cancer.

SUMMARY OF THE INVENTION

The invention relates to isolated multifunctional binding agents comprising single domain antibodies that bind to human PD-1 as described herein. In particular, the invention relates to isolated multiparatopic binding molecules that bind to human PD-1 and related methods for treating disease.

Described herein are human variable single domain antibodies generated in vivo in transgenic mice that bind to human PD-1, but do not block the functional interaction between human PD-1 and its ligands. Such anti-PD-1 $V_H$ single domain antibodies bind an epitope that is distant from the part of the PD-1 protein that interacts with its ligands PD-L1 and PD-L2 and that is therefore outside the region of binding of known therapeutics targeting PD-1.

Described herein are also human variable single domain antibodies generated in vivo in transgenic mice that bind to human PD-1 and block the functional interaction between human PD-1 and its ligands. The inventors have surprisingly found that when a blocking and a non blocking variable single domain antibody are combined in a single molecule, this results in a synergistic antagonistic effect compared to the effect of a monovalent molecules. Thus, surprisingly, the combination of the two in a single molecule leads to an effect that is greater than the effect provided by either entity alone or the combined effect when in monovalent format. Thus, T-cell effector function can be increased by use of the mulitparatopic molecule.

Therefore, in one aspect, the invention relates to an isolated binding agent comprising a) a first single domain antibody directed against a first epitope of human PD-1 and b) a second single domain antibody directed against a second epitope of human PD-1.

In one embodiment, said domain of the single domain antibody is a human heavy chain variable domain ($V_H$).

In one embodiment, said first single domain antibody does not block the interaction of human PD-1 with human PD-L1 and/or PD-L2 and wherein said second single domain antibody blocks the interaction of human PD-1 with human PD-L1 and/or PD-L2.

In one embodiment, said first single domain antibody binds to an epitope comprising one or more or all residues selected from $R^{104}$, $D^{105}$, $F^{106}$, $M^{108}$, $S^{109}$ and $V^{110}$ of human PD-1.

In one embodiment, said first single domain antibody comprises a CDR3 as shown in SEQ ID NO. 3 or 254 or a sequence with at least 90% homology thereto.

In one embodiment, said first single domain antibody comprises a CDR1 as shown in SEQ ID NO. 1 or a sequence with at least 90% homology thereto, a CDR2 as shown in SEQ ID NO. 2 or a sequence with at least 90% homology thereto and a CDR3 as shown in SEQ ID NO. 3 or a sequence with at least 90% homology thereto. In one embodiment, said first single domain antibody comprises a CDR1 as shown in SEQ ID NO. 251 or SEQ ID No. 251 with 1 or 2 amino acid substitutions, a CDR2 as shown in SEQ ID No. 252 or SEQ ID No. 252 with 1 to 5 amino acid substitutions and a CDR3 as shown in SEQ ID No. 253 or SEQ ID No. 253 with 1 to 5 amino acid substitutions.

In one embodiment, said first single domain antibody comprises a CDR1, 2 and 3 selected from Table 1.

In one embodiment, said first single domain antibody comprises a sequence selected from SEQ ID NO. 4, 8, 12, 16, 20, 24, 28, 32, 36, 40, 44, 48, 52, 56, 60, 64, 68, 72, 76, 80, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 254, 258, 262, 266, 270, 274, 278, 282, 286, 290, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, 434, 438, 442, 446, 450, 454, 458 or 462 or a sequence with at least 60%, 70%, 80% or 90% homology thereto.

In one embodiment, said second single domain antibody comprises a CDR3 as shown in SEQ ID NO. 516 or a sequence with at least 90% homology thereto. In one embodiment, said second single domain antibody comprises a CDR1 as shown in SEQ ID No. 516 or SEQ ID No. 516 with 1 or 2 amino acid substitutions, a CDR2 as shown in SEQ ID No. 517 or SEQ ID No. 517 with 1 to 5 amino acid substitutions and a CDR3 as shown in SEQ ID No. 518 or SEQ ID No. 518 with 1 to 5 amino acid substitutions.

In one embodiment, said second single domain antibody comprises a CDR1, 2 and 3 selected from Table 2.

In one embodiment, said second single domain antibody comprises a sequence selected from SEQ ID NO. 519, 523, 527, 531, 535, 539, 543, 547, 551, 555, 559, 563, 567, 571, 575, 579, 583, 587, 591, 595, 599, 603, 607, 611, 615, 619, 623, 627, 631, 635, 639, 643, 647, 651, 655, 659, 663, 667, 671, 675, 679, 683, 687, 691, 695, 699, 703, 707, 711, 715, 719, 723, 727, 731, 735, 739, 743, 747, 751, 755, 759, 763, 767, 771, 775, 779, 783, 787, 791, 795, 799, 803, 807, 884, 888, 892, 896, 900, 904, 908, 912, 916, 920, 924, 928, 932, 936, 940, 944, 948, 952, 956, 960, 964, 968, 972, 976, 980, 984, 988, 992, 996, 1000, 1004, 1008, 1012, 1016, 1020, 1024, 1028, 1032, 1036, 1040, 1044 or 1048 or a sequence with at least 60%, 70%, 80% or 90% homology thereto.

In one embodiment, said first and second single domain antibody are covalently linked by via a peptide. In one embodiment, said peptide linker is between 3 and 50 amino acids in length. In one embodiment, the peptide linker comprises glycine and serine amino acid residues In one embodiment, the peptide linker has the formula (Gly4Ser)n, where n=from 1 to 20. In one embodiment, said binding agent comprises one or more further binding molecules. In one embodiment, said binding molecule is an antibody or fragment thereof. In one embodiment, said binding molecule is a single domain antibody. In one embodiment, said binding molecule binds to an epitope on human PD-1. In one embodiment, said binding molecule binds to a different antigen, i.e. an antigen that is not PD-1. In one embodiment, said binding molecule binds to an immonooncology target.

In one embodiment, at least one single domain antibody is conjugated to a toxin, enzyme, radioisotope, half-life extending moiety, therapeutic molecule or other chemical moiety. In one embodiment, said half-life extending moiety is selected from the group consisting of an albumin binding moiety, a transferrin binding moiety, a polyethylene glycol molecule, a recombinant polyethylene glycol molecule, human serum albumin, a fragment of human serum albumin, and an albumin binding peptide or single domain antibody that binds to human serum albumin.

In one embodiment, said first single domain antibody is located N-terminally and said second single domain antibody is located C-terminally. In one embodiment, said first single domain antibody is located C-terminally and said second single domain antibody is located N-terminally.

In another aspect, the invention relates to an immunoconjugate comprising a binding agent as set out herein linked to a therapeutic agent.

In another aspect, the invention relates to a pharmaceutical composition comprising a binding agent or an immunoconjugate as set out herein and a pharmaceutical carrier.

In another aspect, the invention relates to a method for treating cancer, an immune disorder or viral infection comprising administering a therapeutically effective amount of a comprising a binding agent, an immunoconjugate or a pharmaceutical composition as set out herein.

In another aspect, the invention relates to the use of a binding agent, an immunoconjugate or a pharmaceutical composition as set out herein in the manufacture of a medicament for the treatment of a cancer, an immune disorder, neurological disease, inflammatory disorder, allergy, transplant rejection, viral infection, immune deficiency, and other immune system-related disorder.

In another aspect, the invention relates to a binding agent, an immunoconjugate or a pharmaceutical composition as set out herein for use as medicament.

In another aspect, the invention relates to binding agent, an immunoconjugate or a pharmaceutical composition agent as set out herein for use in the treatment of a cancer, an immune disorder, neurological disease, inflammatory disorder, allergy, transplant rejection, viral infection, immune deficiency, and other immune system-related disorder.

In one embodiment said cancer is selected from bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, breast cancer, brain cancer, uterine cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the thyroid gland, cancer of the parathyroid gland, cancer of the adrenal gland, kidney cancer, sarcoma of soft tissue, cancer of the urethra, cancer of the bladder, renal cancer, lung cancer, leukemia, lymphomas, such as such as Hodgkin's disease, non-Hodgkin's and multiple myelomas.

In another aspect, the invention relates to a method of modulating an immune response comprising administering a binding agent, an immunoconjugate or a pharmaceutical composition as set out herein.

In another aspect, the invention relates to an isolated nucleic acid molecule comprising a nucleotide sequence encoding a binding agent as set out herein. In another aspect, the invention relates to a vector comprising a nucleic acid as herein. In another aspect, the invention relates to host cell comprising a nucleic acid or a vector as set out herein.

In another aspect, the invention relates to method for producing a binding molecule as set out herein comprising expressing a nucleic acid encoding said binding molecule in a host cell and isolating the binding molecule from the host cell.

In another aspect, the invention relates to a kit comprising a binding molecule, an immunoconjugate or a pharmaceutical composition as set out herein.

In another aspect, the invention relates to a method for detecting the presence of human PD-1 in a test sample comprising contacting said sample with a binding molecule as set out herein and at least one detectable label and detecting binding of said single domain antibody to human PD-1.

In another aspect, the invention relates to a combination comprising a) a first single domain antibody directed against a first epitope of human PD-1 and b) a second single domain antibody directed against a second epitope of human PD-1.

In one embodiment, the said domain of the single domain antibody is a human heavy chain variable domain ($V_H$).

In one embodiment, the said first single domain antibody does not block the interaction of human PD-1 and human PD-L1 and/or PD-L2 and wherein said single domain antibody blocks the interaction of human PD-1 and human PD-L1 and/or PD-L2.

FIGURES

The invention is further described in the following non-limiting figures.

FIG. 1: a) PDL-2 inhibition assay using blocking Humabody® $V_H$. b) PD-L1 inhibition assay using Humabody® binding $V_H$. c) PDL-2 inhibition assay using binding Humabody® $V_H$.

Figure 2:
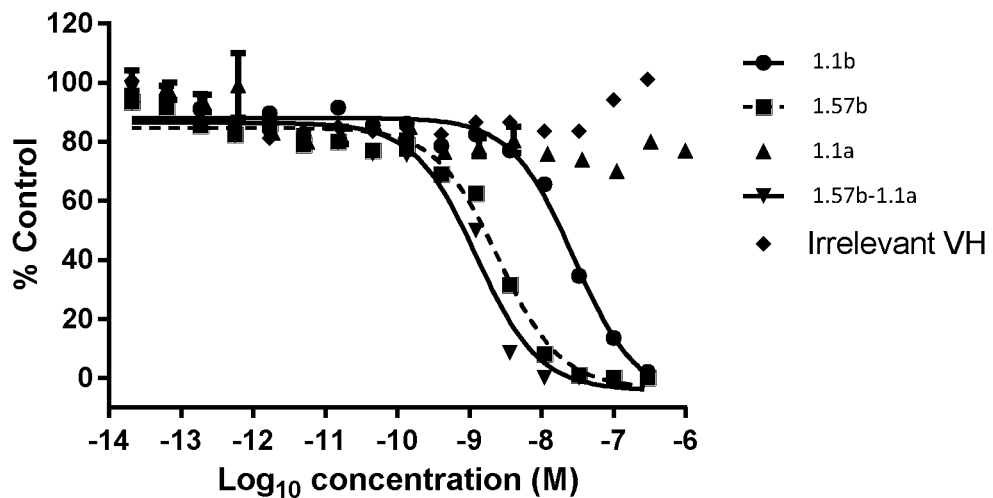
Figure 2:
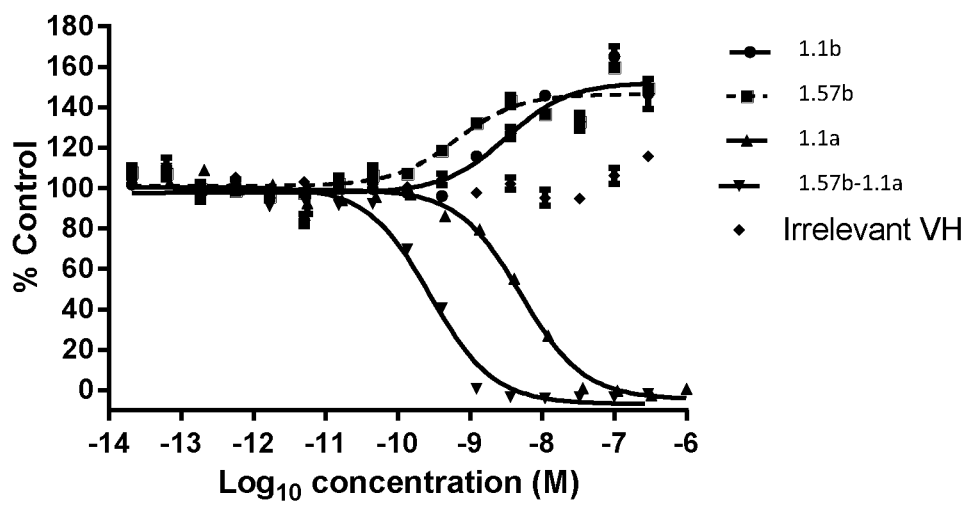

FIG. 2: Epitope competition assay. 1.1a did not cross compete with 1.57b-Strep tagged protein for binding to the cells (FIG. 2a). 1.57b and 1.1b did not cross compete with 1.1a-Strep tagged protein and enhanced binding in the assay (FIG. 2b).

FIG. 3: Example $EC_{50}$ data for activity of binding and blocking Humabody® $V_H$ in a reporter assay.

FIG. 4: Species cross reactivity testing a) binding to human PD-1 b) binding to cynomolgus PD-1 recombinant protein c) binding to mouse PD-1 protein.

Figure 5:
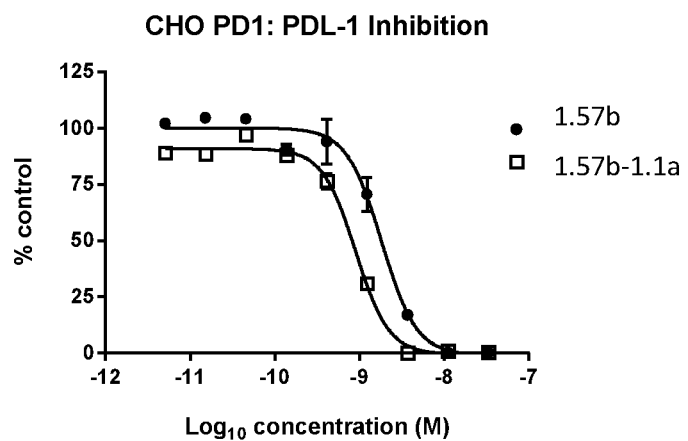
Figure 5:
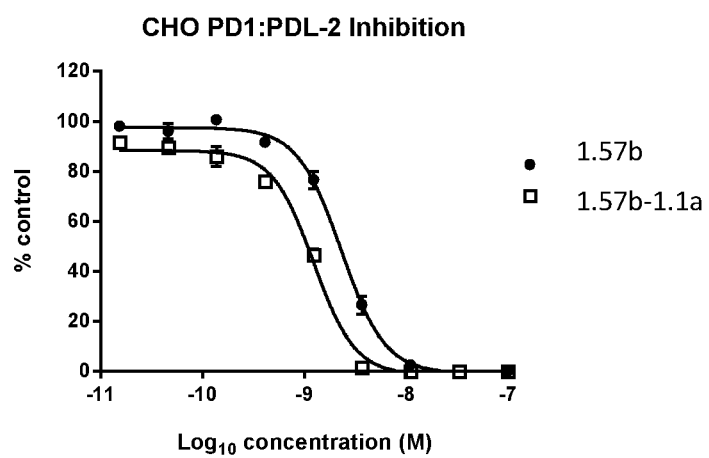

FIG. 5: a) FMAT PD1:PDL1 Inhibition assay using different Humabody® $V_H$. b) CHO PD1/PDL1 c) CHO PD1/PDL2.

Figure 6:
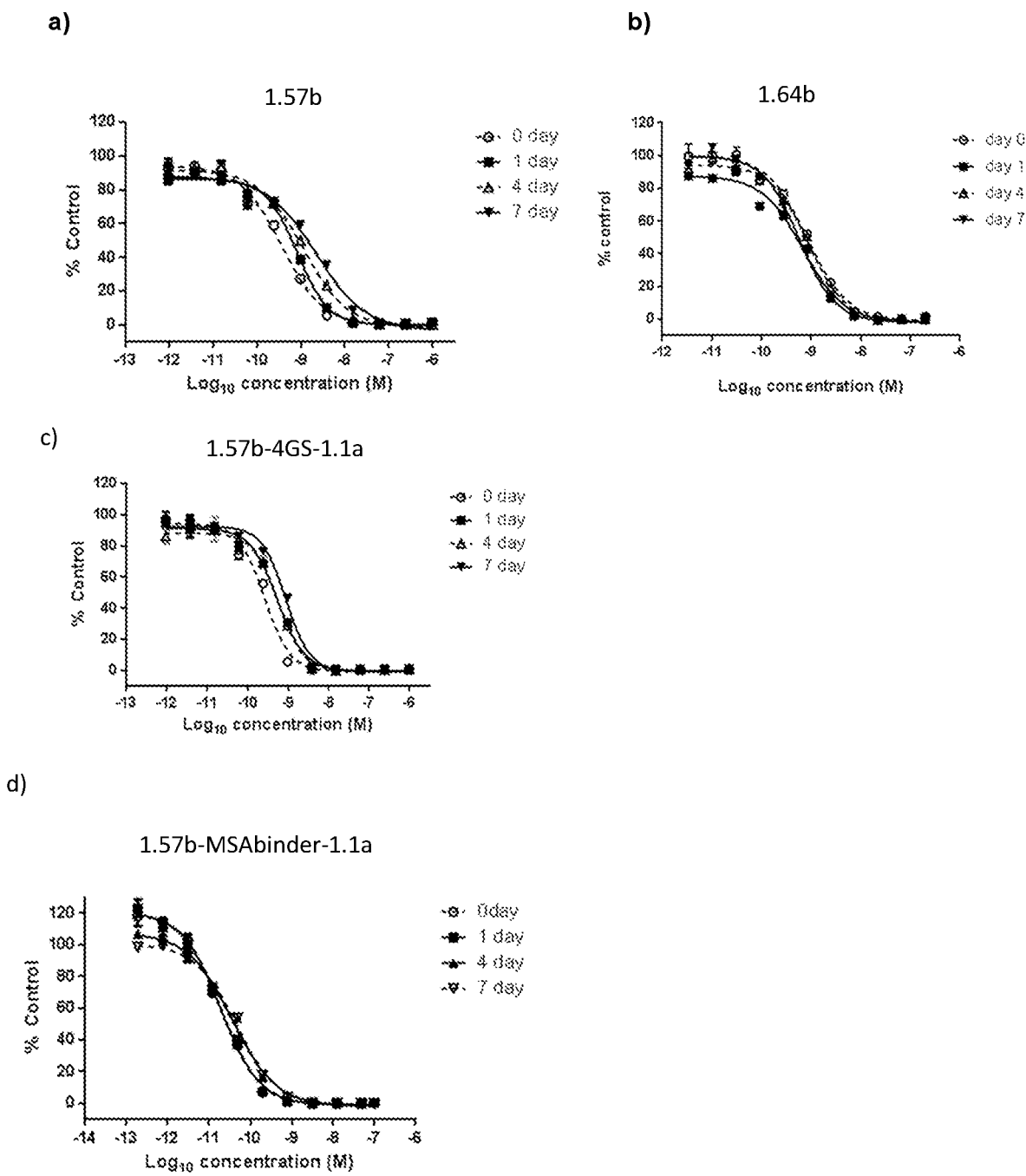

FIG. 6: Serum stability of Humabody® $V_H$.

Figure 7:
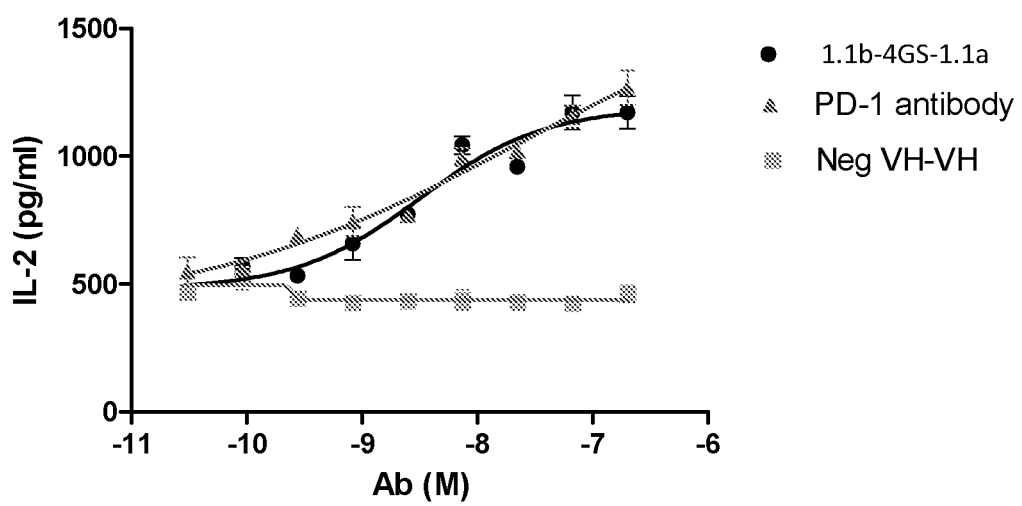
Figure 7:
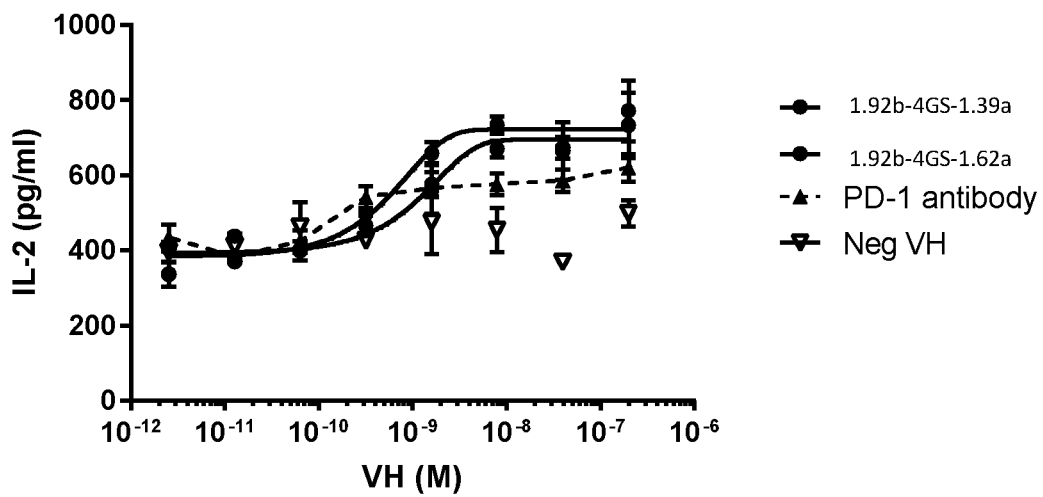

FIG. 7: a) A biparatopic binding molecule enhances IL-2 secretion. Cells were co-cultured with antibody/Humabody® for 2 days and the IL-2 concentration determined by HTRF (Homogenous Time Resolved Fluorescence assay) and b) A biparatopic binding molecule enhances IL-2 secretion. Cells were co-cultured with antibody/HUMABODY® $V_H$ for 2 days and the IL-2 concentration determined by HTRF (Homgenous Time Resolved Fluorescence assay).

Figure 8:
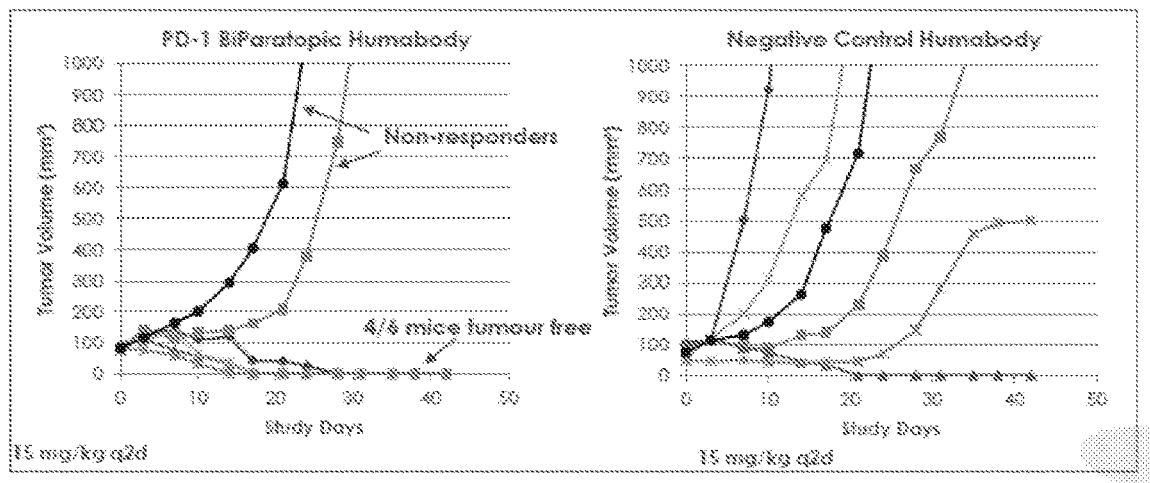

FIG. 8: In Vivo Efficacy of binding agents in HuGEMM PD1 Model with Subcutaneous MC38 Mouse Colon Adenocarcinoma.

Figure 9:
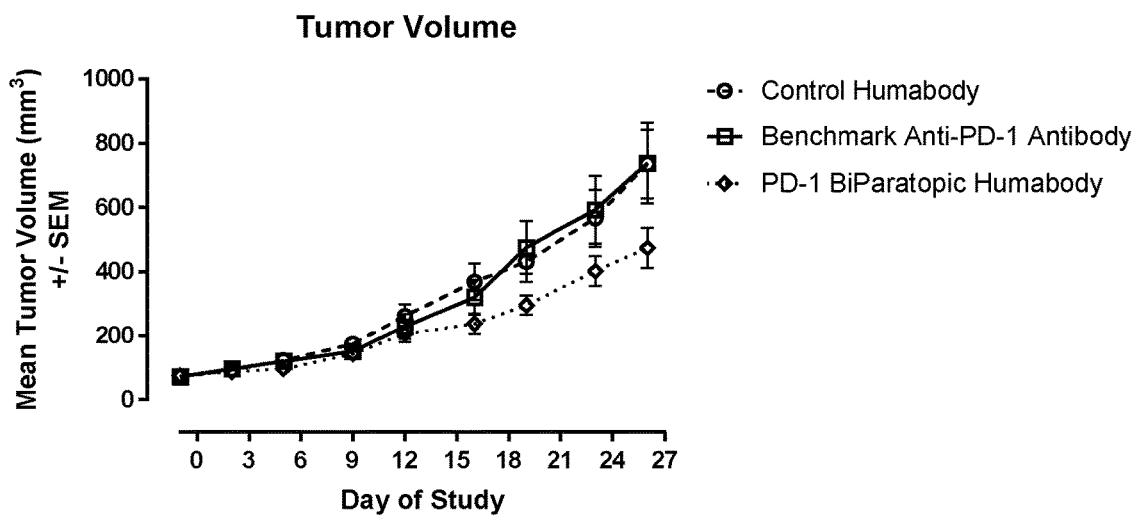

FIG. 9: In Vivo Efficacy of binding agents in hu-CD34 NSG™ mice.

Figure 10:
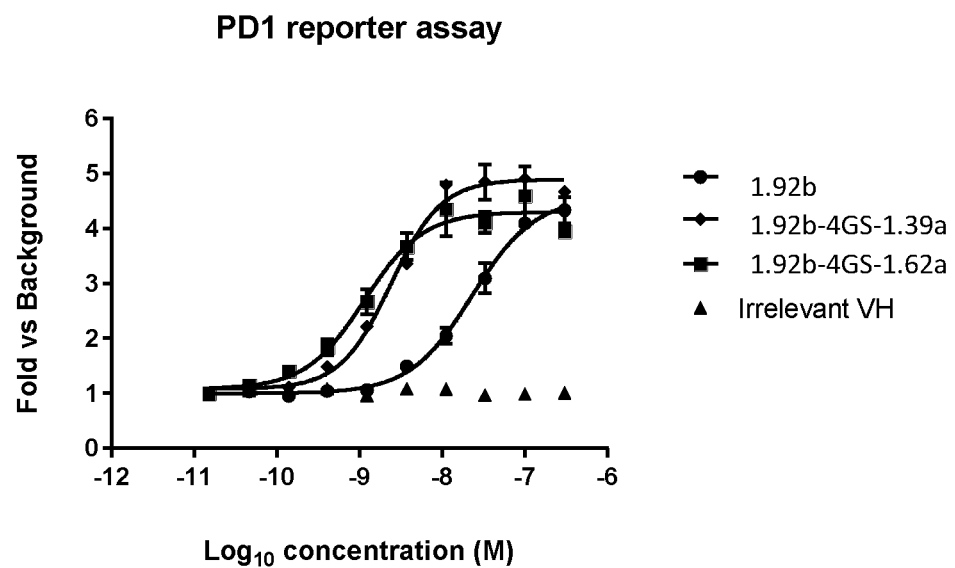

FIG. 10. Functional reporter gene assay. Different single domain antibodies were tested together with a biparatopic molecule.

DETAILED DESCRIPTION

Various aspects and embodiments will now be further described. In the following passages, different aspects of the invention are defined in more detail. Each aspect so defined may be combined with any other aspect or aspects unless clearly indicated to the contrary. In particular, any feature indicated as being preferred or advantageous may be combined with any other feature or features indicated as being preferred or advantageous.

Generally, nomenclatures used in connection with, and techniques of, cell and tissue culture, pathology, oncology, molecular biology, immunology, microbiology, genetics and protein and nucleic acid chemistry and hybridization described herein are those well-known and commonly used in the art. The methods and techniques of the present disclosure are generally performed according to conventional methods well-known in the art and as described in various general and more specific references that are cited and discussed throughout the present specification unless otherwise indicated. See, e.g., Green and Sambrook et al., Molecular Cloning: A Laboratory Manual, 4th ed., Cold Spring Harbor Laboratory Press, Cold Spring Harbor, N.Y. (2012); Therapeutic Monoclonal Antibodies: From Bench to Clinic, Zhiqiang An (Editor), Wiley, (2009); and Antibody Engineering, 2nd Ed., Vols 1 and 2, Ontermann and Dubel, eds., Springer-Verlag, Heidelberg (2010).

Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, and delivery, and treatment of patients.

Described herein are human $V_H$ single domain antibodies that bind to human PD-1, but do not block the interaction between human PD-1 and its ligands as demonstrated in the functional assays in the examples. By not block the interaction between human PD-1 and its ligands is meant the functional interaction between human PD-1 and its ligands. Described herein are such human $V_H$ single domain antibodies which are used in the multifunctional molecules and bind to an epitope that is distinct from the binding site of human PD-1 to PD-L1 or PDL-2. These anti-PD-1 antibodies are particularly useful in combination with an anti-PD-1 single domain antibody that neutralises PD-1.

In one aspect, the invention thus provides an isolated binding agent comprising a) a first single domain antibody directed against a first epitope of human PD-1 and b) a second single domain antibody directed against a second epitope of human PD-1.

In one aspect, the invention relates to an isolated binding agent comprising a) a first single domain antibody directed against a first epitope of human PD-1 which does not block binding to PD-L1 and/or PD-L2 and/or does not block the interaction between human PD-1 and PD-L1 and/or PD-L2 and b) a second single domain antibody directed against a second epitope of human PD-1 which blocks binding to PD-L1 and/or PD-L2. In one embodiment, said binding molecule exhibits one or more or all of the following properties:

(a) binds to human PD-1 with a KD as measured in the examples;

(b) increases IL-2 secretion in an Mixed Lymphocyte Reaction assay;

(c) binds to human PD-1 and cynomolgus monkey PD-1;

(d) does not bind to mouse PD-1;

(e) inhibits the binding of PD-L1 and/or PD-L2 to PD-1;

(f) inhibits tumour cell growth in vivo (e.g. as measured in the examples using hu-CD34 NSG™ mice), compared to a human PD-1 antibody treatment which on average shows no effect;

(g) exhibits better blocking activity, for example in a cell based assay as shown in the examples (Jurkat cells, FIG. 10), than the blocking single domain antibody used in a monovalent format. For example, this may be a 10 to 25 fold increase;

(h) has an EC50 or IC50 value as measured in the examples;

(i) elicits tumor regression in vivo (e.g. as measured in the examples using in a HuGEMM PD1 Model with Subcutaneous MC38 Mouse Colon Adenocarcinoma);

(j) induces IL-2 and TNFα secretion in BioMap® Oncology CRC panel compared to a benchmark human PD-1 monoclonal antibody.

Suitable assays to measure the properties as set out above are described in the examples, for example as shown in examples 9, 11, 12 and 13.

The terms "first" and "second" are used to differentiate between the two PD-1 binding single domain antibodies used in the binding molecules of the invention, but are not understood to designate their orientation in the multivalent molecule with respect to the C and N terminus of the protein. For example, the first single domain antibody may be located N-terminally and the second single domain antibody may be located at the C-terminally. Alternatively, the first single domain antibody may be located at the C-terminally of the molecule and the second single domain antibody may be located at the N-terminally. C-terminally can mean that the C-terminus of the molecule or C terminally with respect to the first/second PD-1 binding molecule. N-terminally can mean that the N-terminus of the molecule or C terminally with respect to the first/second PD-1 binding molecule.

The invention also provides a combination and combination therapy comprising a) a first single domain antibody directed against a first epitope of human PD-1 and b) a second single domain antibody directed against a second epitope of human PD-1.

The invention also provides pharmaceutical compositions comprising such binding molecules and combinations, as well as isolated nucleic acids, isolated recombinant expression vectors and isolated host cells for making such binding proteins. Also provided are methods of using the binding agent disclosed herein to detect human PD-1 and methods of treating disease.

In preferred embodiments, the first and second single domain antibody is a single domain antibody wherein the domain is a human variable heavy chain ($V_H$) domain.

As used herein, the term "do not block or do not inhibit the interaction of human PD-1 with its ligands" refers to the functional interaction of human PD-1 with its ligands. In other words, the binding of such single domain antibodies used in the binding agents of the invention does not abolish or reduce the functional interaction of human PD-1 with its ligands. Thus, the binding of the single domain antibodies used in the binding agents of the invention to human PD-1 does not affect the biological function of the interaction of human PD-1 with its ligands. In one embodiment, the ligand is PD-L1. In one embodiment, the ligand is PD-L2.

The properties of the multifunctional binding agents as described herein can be exploited in therapeutic methods and uses. binding agents as described herein are for example useful in anchoring, associating or bringing into proximity other therapeutic molecule to human PD-1, for example in a targeted therapy to recruit the therapeutic compound to the cell or tissue of interest or to a region of the cell associated with PD-1 localisation. This makes the binding agents as described herein particularly suitable for delivery together with other compounds. This can be done in the same medicament, or by sequential administration of separate compositions.

Binding agents as described herein bind specifically to wild type human PD-1 (UniProt Accession No. Q15116, GenBank Accession No. U64863, SEQ ID No. 1093). Residues 1-20 OF SEQ ID No. 1093 correspond to the presequence, residues 171 and beyond make up the transmembrane helix and the intracellular domain of PD-1.

Unless otherwise specified, the term PD-1 as used herein refers to human PD-1. The terms "Programmed Death 1," "Programmed Cell Death 1," "Protein PD-1," "PD-1," PD1," "PDCD1," "hPD-1" and "hPD-1" are used interchangeably, and include variants, isoforms, species homologs of human PD-1

The terms "PD-1 binding molecule/protein/polypeptide/ agent", "PD-1 antigen binding molecule protein/polypeptide/agent", "anti-PD-1 single domain antibody", "anti-PD-1 single immunoglobulin variable domain", "anti-PD1 heavy chain only antibody" or "anti-PD-1 antibody" all refer to a molecule capable of specifically binding to the human PD-1 antigen. The binding reaction may be shown by standard methods, for example with reference to a negative control test using an antibody of unrelated specificity. The term "PD-1 binding molecule/agent" includes a PD-1 binding protein.

An antibody or binding molecule of the invention, "which binds" or is "capable of binding" an antigen of interest, e.g. PD-1, is one that binds the antigen with sufficient affinity such that the antibody is useful as a therapeutic agent in targeting a cell or tissue expressing the antigen.

Binding molecules of the invention bind specifically to human PD-1. In other words, binding to the PD-1 antigen is measurably different from a non-specific interaction. As demonstrated in the examples, the single domain antibodies of the invention do not cross react with mouse PD-1. Preferably, the single domain antibodies of the invention bind to human PD-1 and also bind to cyno PD-1.

The term "specific binding" or "specifically binds to" or is "specific for" a particular polypeptide or an epitope on a particular polypeptide target as used herein can be exhibited, for example, by a molecule having a KD for the target of at least about $10^{-4}$ M, alternatively at least about $10^{-5}$ M, alternatively at least about $10^{-6}$ M, alternatively at least about $10^{-7}$ M, alternatively at least about $10^{-8}$ M, alternatively at least about $10^{-9}$ M, alternatively at least about $10^{-10}$ M, alternatively at least about $10^{-11}$ M, alternatively at least about $10^{-12}$ M, or greater. In one embodiment, the term "specific binding" refers to binding where a molecule binds to a particular polypeptide or epitope on a particular polypeptide without substantially binding to any other polypeptide or polypeptide epitope. In one embodiment, the binding agent has an affinity in the nanomolar to picomolar range.

In one embodiment, the binding agent specifically binds to human PD-1 with a binding affinity of Kd $10^{-9}$ to $10^{-12}$ M, for example $10^{-9}$, $10^{-10}$, $10^{11}$, $10^{-12}$ M, measured using surface plasmon resonance (Biacore) or bio-light interferometry (for example ForteBio Octet).

In one embodiment, the binding agent inhibits the binding of human PD-L1 or human PD-L2 to human PD-1 with an $IC_{50}$ value in the low nanomolar to picomolar range, for example in the subnanomolar range.

The term "antibody" broadly refers to any immunoglobulin (Ig) molecule, or antigen binding portion thereof, comprised of four polypeptide chains, two heavy (H) chains and two light (L) chains, or any functional fragment, mutant, variant, or derivation thereof, which retains the essential epitope binding features of an Ig molecule. Such mutant, variant, or derivative antibody formats are known in the art.

In a full-length antibody, each heavy chain is comprised of a heavy chain variable region or domain (abbreviated herein as HCVR) and a heavy chain constant region. The heavy chain constant region is comprised of three domains, $C_H1$, $C_H2$ and $C_H3$. Each light chain is comprised of a light chain variable region or domain (abbreviated herein as LCVR) and a light chain constant region. The light chain constant region is comprised of one domain, $C_L$.

The heavy chain and light chain variable regions can be further subdivided into regions of hypervariability, termed complementarity determining regions (CDR), interspersed with regions that are more conserved, termed framework regions (FR). Each heavy chain and light chain variable region is composed of three CDRs and four FRs, arranged from amino-terminus to carboxy-terminus in the following order: FR1, CDR1, FR2, CDR2, FR3, CDR3, FR4. Immunoglobulin molecules can be of any type (e.g., IgG, IgE, IgM, IgD, IgA and IgY), class (e.g., IgG 1, IgG2, IgG 3, IgG4, IgAl and IgA2) or subclass.

The term "CDR" refers to the complementarity-determining region within antibody variable sequences. There are three CDRs in each of the variable regions of the heavy chain and the light chain, which are designated CDR1, CDR2 and CDR3, for each of the variable regions. The term "CDR set" refers to a group of three CDRs that occur in a single variable region capable of binding the antigen. The exact boundaries of these CDRs can be defined differently according to different systems known in the art.

The Kabat Complementarity Determining Regions (CDRs) are based on sequence variability and are the most commonly used (Kabat et al., (1971) Ann. NY Acad. Sci. 190:382-391 and Kabat, et al., (1991) Sequences of Proteins of Immunological Interest, Fifth Edition, U.S. Department of Health and Human Services, NIH Publication No. 91-3242). Chothia refers instead to the location of the structural loops (Chothia and Lesk J. Mol. Biol. 196:901-917 (1987)). The Kabat numbering system is generally used when referring to a residue in the variable domain (approximately residues 1-107 of the light chain and residues 1-113 of the heavy chain).

The system described by Kabat is used herein unless otherwise specified. The terms "Kabat numbering", "Kabat definitions" and "Kabat labeling" are used interchangeably herein. These terms, which are recognized in the art, refer to a system of numbering amino acid residues which are more variable (i.e., hypervariable) than other amino acid residues in the heavy and light chain variable regions of an antibody, or an antigen binding portion.

A chimeric antibody is a recombinant protein that contains the variable domains including the complementarity determining regions (CDRs) of an antibody derived from one species, preferably a rodent antibody, while the constant domains of the antibody molecule are derived from those of a human antibody. For veterinary applications, the constant domains of the chimeric antibody may be derived from that of other species, such as a cat or dog.

A humanized antibody is a recombinant protein in which the CDRs from an antibody from one species; e.g., a rodent antibody, are transferred from the heavy and light variable chains of the rodent antibody into human heavy and light variable domains (e.g., framework region sequences). The constant domains of the antibody molecule are derived from those of a human antibody. In certain embodiments, a limited number of framework region amino acid residues from the parent (rodent) antibody may be substituted into the human antibody framework region sequences.

The term "antigen binding site" refers to the part of the antibody or antibody fragment that comprises the area that specifically binds to an antigen. An antigen binding site may be provided by one or more antibody variable domains. Preferably, an antigen binding site is comprised within the associated $V_H$ and $V_L$ of an antibody or antibody fragment.

An antibody fragment is a portion of an antibody, for example as $F(ab')_2$, Fab, Fv, sFv and the like. Functional fragments of a full length antibody retain the target specificity of a full length antibody. Recombinant functional antibody fragments, such as Fab (Fragment, antibody), scFv (single chain variable chain fragments) and single domain antibodies (dAbs) have therefore been used to develop therapeutics as an alternative to therapeutics based on mAbs.

scFv fragments (~25 kDa) consist of the two variable domains, $V_H$ and $V_L$. Naturally, $V_H$ and $V_L$ domain are non-covalently associated via hydrophobic interaction and tend to dissociate. However, stable fragments can be engineered by linking the domains with a hydrophilic flexible linker to create a single chain Fv (scFv).

The smallest antigen binding fragment is the single variable fragment, namely the $V_H$ or $V_L$ domain. Binding to a light chain/heavy chain partner respectively is not required for target binding. Such fragments are used in single domain antibodies. A single domain antibody (~12 to 15 kDa) therefore consists of or comprises either the $V_H$ or $V_L$ domain.

The terms "single domain antibody, variable single domain or immunoglobulin single variable domain (ISV)" are all well known in the art and describe the single variable fragment of an antibody that binds to a target antigen. These terms are used interchangeably herein. As explained below, preferred embodiments of the various aspects of the invention relate to a binding agent comprising at least two single heavy chain variable domain antibodies/immunoglobulin heavy chain single variable domains which bind a PD-1 antigen in the absence of light chain. One embodiment thus relates to single human heavy chain variable domain ($V_H$) antibodies. Such binding molecules are also termed Humabody® herein. Humabody® is a registered trademark of Crescendo Biologics Ltd.

Thus, in some preferred embodiments, the isolated binding agents/molecules of the invention comprise at least two single domain antibody wherein said domain is a human heavy chain variable domain. Thus, in one aspect, the binding agents of the invention comprise or consist of at least two human immunoglobulin single variable heavy chain domains; they are devoid of $V_L$ domains.

The term "isolated" binding agent refers to binding agent that is substantially free of other binding agents, antibodies or antibody fragments having different antigenic specificities. Moreover, an isolated binding agent may be substantially free of other cellular material and/or chemicals.

A "blocking binding agent, single domain antibody or antibody" or a "neutralizing binding agent, single domain antibody or antibody", as used herein is intended to refer to an antibody whose binding to PD-1 results in inhibition of at least one biological activity of PD-1. For example, a blocking single domain antibody or multivalent binding agent as described herein may prevent or block PD-1 binding to PD-L1 and/or PD-L2.

Each single $V_H$ domain antibody comprises three CDRs and four FRs, arranged from amino-terminus to carboxy-terminus in the following order: FR1-CDR1-FR2-CDR2-FR3-CDR3-FR4. Thus, in one embodiment of the invention, the domain is a human variable heavy chain ($V_H$) domain with the following formula FR1-CDR1-FR2-CDR2-FR3-CDR3-FR4.

Modifications to the C or N-terminal $V_H$ framework sequence may be made to the single domain antibodies used in the invention to improve their properties. For example, the $V_H$ domain may comprise C or N-terminal extensions or deletions. C-terminal extensions or deletions can be added to/deleted from the C terminal end of a $V_H$ domain which terminates with the residues VTVSS (SEQ ID No. 1091).

In one embodiment, the single domain antibodies used in the invention comprise C-terminal extensions/deletions of from 1 to 50 residues, for example 1 to 25, for example 1, 2, 3, 4, 5, 6, 7, 8, 9 or 10 additional amino acids. In one embodiment, the single domain antibodies of the invention comprise additional amino acids of the human $C_H1$ domain thus that the C-terminal end extends into the $C_H1$ domain. In one embodiment, said extension comprises at least 1 alanine residue, for example a single alanine residue, a pair of alanine residues or a triplet of alanine residues.

Additional C or N-terminal residues can be linkers that are employed to conjugate the single domain antibodies used in the invention to another moiety, or tags that aid the detection of the molecule. Such tags are well known in the art and include for, example linker His tags, e.g., hexa-His (HHHHHH, SEQ ID No. 1092) or myc tags.

As used herein, the term "homology" generally refers to the percentage of amino acid residues in a sequence that are identical with the residues of the reference polypeptide with which it is compared, after aligning the sequences and in some embodiments after introducing gaps, if necessary, to achieve the maximum percent homology, and not considering any conservative substitutions as part of the sequence identity. Thus, the percent homology between two amino acid sequences is equivalent to the percent identity between the two sequences. Neither N- or C-terminal extensions, tags or insertions shall be construed as reducing identity or homology. Methods and computer programs for the alignment are well known. The percent identity between two amino acid sequences can be determined using well known mathematical algorithms.

According to the various aspects and embodiments of the invention, the variable domain of the single domain antibodies of the binding molecules of the invention is preferably a human variable domain ($V_H$). As used herein, a human $V_H$ domain includes a fully human or substantially fully human $V_H$ domain. As used herein, the term human $V_H$ domain also includes $V_H$ domains that are isolated from heavy chain only antibodies made by transgenic mice expressing fully human immunoglobulin heavy chain loci, in particular in response to an immunisation with an antigen of interest, for example as described in WO2016/062990 and in the examples. In one embodiment, a human $V_H$ domain can also include a $V_H$ domain that is derived from or based on a human $V_H$ domain amino acid or nucleic acid sequence encoding such $V_H$ domain. Thus, the term includes variable heavy chain regions derived from or encoded by human germline immunoglobulin sequences. A substantially human $V_H$ domain or $V_H$ domain that is derived from or based on a human $V_H$ domain may include amino acid residues not encoded by human germline immunoglobulin sequences (e.g., mutations introduced in vitro, e.g. by random or site-specific mutagenesis, or introduced by somatic mutation in vivo). The term "human $V_H$ domain" therefore also includes a substantially human $V_H$ domain wherein one or more amino acid residue has been modified. For example, a substantially human $V_H$ domain the $V_H$ domain may include up to 10, for example 1, 2, 3, 4 or 5 amino acid modifications compared to a fully human sequence.

However, the term "human $V_H$ domain" or "substantially human $V_H$ domain", as used herein, is not intended to include antibodies in which CDR sequences derived from the germline of another mammalian species, such as a mouse, have been grafted onto human framework sequences. Preferably, the term "human $V_H$ domain", as used herein, is also not intended to include camelized $V_H$ domains, that is human $V_H$ domains that have been specifically modified, for example in vitro by conventional mutagenesis methods to select predetermined positions in the $V_H$ domains sequence and introduce one or more point mutation at the predetermined position to change one or more predetermined residue to a specific residue that can be found in a camelid $V_{HH}$ domain.

The binding agent is biparatopic. Thus, the binding molecule may comprise a first $V_H$ single domain antibody ($V_H(A)$) binding to a first epitope on human PD-1 and a second $V_H$ single domain antibody ($V_H(B)$) binding to a second epitope on human PD-1 and thus has the following formula: $V_H(A)$-$V_H(B)$ or $V_H(B)$-$V_H(A)$.

Each $V_H$ comprises CDR and FR regions. The order of the immunoglobulin single variable domains A and B is not particularly limited, so that, within a polypeptide of the invention, immunoglobulin single variable domain A may be located N-terminally and immunoglobulin single variable domain B may be located C-terminally, or vice versa. The $V_H$ domain antibodies are typically connected via a linker. Suitable linkers include for example a linker with GS residues such as (Gly$_4$Ser)n, where n=from 1 to 10 or 1 to 20, e.g., 1, 2, 3, 4, 5, 6, 7, 8, 9 or 10.

Thus, the binding molecule may have the following formula: FR1(A)-CDR1(A)-FR2(A)-CDR2(A)-FR3(A)-CDR3(A)-FR4(A)-linker-FR1(B)-CDR1(B)-FR2(B)-CDR2(BA)-FR3(B)-CDR3(B)-FR4(B) or FR1(B)-CDR1(B)-FR2(B)-CDR2(BA)-FR3(B)-CDR3(B)-FR4(B)-linker-FR1 (A)-CDR1(A)-FR2(A)-CDR2(A)-FR3(A)-CDR3(A)-FR4(A)

Examples of first and second human $V_H$ single domain antibodies that form PD-1 binding arms of the multivalent binding agents described herein are set out below.

Described are $V_H$ domains that bind to PD-1 and do not block ligand binding; these bind to PD-1 at common residues of PD-1, namely $R^{104}$, $D^{105}$, $F^{106}$, $H^{107}$, $M^{108}$, $S^{109}$ and $V^{110}$ of human PD-1. In one embodiment, the invention relates thus to an isolated single domain antibody that binds to an epitope, epitope part, domain, subunit or conformation of human PD-1 comprising one or more or all of the residues selected from $R^{104}$, $D^{105}$, $F^{106}$, $H^{107}$, $M^{108}$, $S^{109}$ and $V^{110}$ of human PD-1.

In one embodiment, said epitope, epitope part, domain, subunit or conformation further comprises one or more or all of $G^{103}$, $V^{111}$, $R^{112}$ and $A^{113}$.

In one embodiment, said epitope, epitope part, domain, subunit or conformation comprises $G^{103}$. In one embodiment, said epitope, epitope part, domain, subunit or conformation comprises $R^{104}$. In one embodiment, said epitope, epitope part, domain, subunit or conformation comprises $S^{109}$. In one embodiment, said epitope, epitope part, domain, subunit or conformation comprises $V^{110}$. In one embodiment, said epitope, epitope part, domain, subunit or conformation comprises $V^{111}$. In one embodiment, said epitope, epitope part, domain, subunit or conformation comprises $R^{112}$. In one embodiment, said epitope, epitope part, domain, subunit or conformation comprises $A^{113}$. In one embodiment, said epitope, epitope part, domain, subunit or conformation comprises all of $G^{103}$, $R^{104}$, $S^{109}$, $V^{110}$, $V^{111}$, $R^{112}$ and $A^{113}$ of human PD-1.

In one embodiment, said epitope, epitope part, domain, subunit or conformation further comprises one or more of residues $N^{102}$, $D^{105}$, $F^{106}$, $H^{107}$, $M^{108}$, $R^{114}$ and $R^{115}$ of human PD-1. In one embodiment, said epitope, epitope part, domain, subunit or conformation comprises $N^{102}$. In one embodiment, said epitope, epitope part, domain, subunit or conformation comprises $D^{105}$. In one embodiment, said epitope, epitope part, domain, subunit or conformation comprises $F^{106}$. In one embodiment, said epitope, epitope part, domain, subunit or conformation comprises $H^{107}$. In one embodiment, said epitope, epitope part, domain, subunit or conformation further comprises $M^{108}$. In one embodiment, said epitope, epitope part, domain, subunit or conformation comprises $R^{114}$. In one embodiment, said epitope, epitope part, domain, subunit or conformation comprises $R^{115}$. In one embodiment, said epitope, epitope part, domain, subunit or conformation comprises all of $N^{102}$, $D^{105}$, $F^{106}$, $H^{107}$, $M^{108}$, $R^{114}$ and $R^{115}$ of human PD-1. In one embodiment, said epitope, epitope part, domain, subunit or conformation comprises all of $N^{102}$, $G^{103}$, $D^{105}$, $F^{106}$, $H^{107}$, $M^{108}$, $S^{109}$, $V^{110}$, $V^{111}$, $R^{112}$, $A^{113}$, $R^{114}$ and $R^{115}$ of human PD-1.

In another embodiment, the single domain antibody binds to an epitope comprising one or more or all residues selected from $R^{104}$, $D^{105}$, $F^{106}$, $H^{107}$, $M^{108}$, $S^{109}$ and $V^{110}$ of human PD-1 and further to one or more or all of $S^{60}$, $E^{61}$, $S^{62}$, $F^{63}$, $V^{64}$, $L^{65}$, $N^{66}$, $W^{67}$, $Y^{68}$, $R^{69}$, $M^{70}$, $S^{71}$, $G^{90}$, $Q^{91}$, $D^{92}$, $C^{93}$, $R^{94}$, $F^{95}$, $R^{96}$, $V^{97}$, $T^{98}$, $V^{111}$, $R^{112}$, $A^{113}$ and $R^{11}$.

The term "epitope" or "antigenic determinant" refers to a site on the surface of an antigen (e.g., PD-1) to which an immunoglobulin, antibody or antibody fragment, including a $V_H$ single domain antibody specifically binds. Generally, an antigen has several or many different epitopes and reacts with many different antibodies. The term specifically includes linear epitopes and conformational epitopes.

Epitopes within protein antigens can be formed both from contiguous amino acids (usually a linear epitope) or non-contiguous amino acids juxtaposed by tertiary folding of the protein (usually a conformational epitope). Epitopes formed from contiguous amino acids are typically, but not always, retained on exposure to denaturing solvents, whereas epitopes formed by tertiary folding are typically lost on treatment with denaturing solvents. An epitope typically includes at least 3, 4, 5, 6, 7, 8, 9, 10, 11, 12, 13, 14 or 15 amino acids in a unique spatial conformation. Methods for determining what epitopes are bound by a given antibody or antibody fragment (i.e., epitope mapping) are well known in the art and include, for example, immunoblotting and immunoprecipitation assays, wherein overlapping or contiguous peptides from are tested for reactivity with a given antibody or antibody fragment.

An antibody binds "essentially the same epitope" as a reference antibody, when the two antibodies recognize identical or sterically overlapping epitopes. The most widely used and rapid methods for determining whether two epitopes bind to identical or sterically overlapping epitopes are competition assays, which can be configured in different formats, using either labelled antigen or labelled antibody.

In one embodiment, a first single $V_H$ domain antibody that binds to human PD-1, but does not block ligand binding, comprises a CDR3 sequence as shown Table 1 below or a sequence with at least 60%, 70%, 80%, 90%, 95% or more sequence identity thereto. In one embodiment, said sequence homology is at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. In one embodiment, said sequence homology is at least 90%, 91%, 92%, 93%, 94%, 95%, 96%, 97%, 98% or 99%.

In one embodiment, the first $V_H$ single domain antibody has a CDR3 sequence comprising SEQ ID No. 3, 253, 175, 297 or a sequence having at least 70%, at least 80%, at least 90%, or at least 95% homology thereto.

In one embodiment, the first $V_H$ single domain antibody has a CDR1 as shown in SEQ ID No. 1 or SEQ ID No. 1 with 1 or 2 amino acid substitutions, a CDR2 as shown in SEQ ID No. 2 or SEQ ID No. 2 with 1 to 5 amino acid substitutions and a CDR3 as shown in SEQ ID No. 3 or SEQ ID No. 3 with 1 to 5 amino acid substitutions. In one embodiment, the $V_H$ single domain antibody has a CDR1 as shown in SEQ ID No. 251 or SEQ ID No. 251 with 1 or 2 amino acid substitutions, a CDR2 as shown in SEQ ID No. 252 or SEQ ID No. 252 with 1 to 5 amino acid substitutions and a CDR3 as shown in SEQ ID No. 253 or SEQ ID No. 253 with 1 to 5 amino acid substitutions.

In one embodiment, the first $V_H$ single domain antibody comprises a combination of CDR1, 2 and 3 sequences selected from the CDR1, 2 and 3 sequences shown for a $V_H$ single domain antibody in Table 1 or combinations thereof. In one embodiment, the $V_H$ single domain antibody comprises a set of CDR1, 2 and 3 sequences selected from the sets of CDR1, 2 and 3 sequences as shown for the any of the clones in Table 1. Thus, in one aspect, the first single domain antibody comprises a CDR1, CDR2 and CDR3 selected from CDRs1-3 of full length sequences SEQ ID No: 4, 8, 12, 16, 20, 24, 28, 32, 36, 40, 44, 48, 52, 56, 60, 64, 68, 72, 76, 80, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 254, 258, 262, 266, 270, 274, 278, 282, 286, 290, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, 434, 438, 442, 446, 450, 454, 458 or 462.

Accordingly, in one embodiment, the $V_H$ single domain antibody comprises CDR1 having SEQ ID No. 1, CDR2 having SEQ ID No. 2 and CDR3 having SEQ ID No. 3 (CDRs of SEQ ID NO. 4, i.e. clone 1.1a as shown in table 1), CDR1 having SEQ ID No. 5, CDR2 having SEQ ID No. 6 and CDR3 having SEQ ID No. 7 (CDRs of SEQ ID NO. 8) and so forth. Thus, the first $V_H$ single domain antibody comprises one of the following CDR combinations: SEQ ID Nos. 1, 2, 3; SEQ ID Nos. 5, 6, 7; SEQ ID Nos. 9, 10, 11; SEQ ID Nos. 13, 14, 15; SEQ ID Nos. 17, 18, 19; SEQ ID Nos. 21, 22, 23; SEQ ID Nos. 25, 26, 27; SEQ ID Nos. 29, 30, 31; SEQ ID Nos. 33, 34, 35; SEQ ID Nos. 37, 38, 39; SEQ ID Nos. 41, 42, 43; SEQ ID Nos. 45, 46, 47; SEQ ID Nos. 49, 50, 51; SEQ ID Nos. 53, 54, 55; SEQ ID Nos. 57, 58, 59; SEQ ID Nos. 61, 62, 63; SEQ ID Nos. 65, 66, 67; SEQ ID Nos. 69, 70, 71; SEQ ID Nos.73. 74. 75; SEQ ID Nos. 77, 78, 79; SEQ ID Nos. 101, 102, 103; SEQ ID Nos. 105, 106, 107; SEQ ID Nos. 109, 110, 111; SEQ ID Nos. 113, 114, 115; SEQ ID Nos. 117, 118, 119; SEQ ID Nos. 121, 122, 123; SEQ ID Nos. 125, 126, 127; SEQ ID Nos. 129; 130; 131; SEQ ID Nos. 133, 134, 15; SEQ ID Nos. 137, 138, 139; SEQ ID Nos. 141, 142, 143; SEQ ID Nos. 145, 146, 147; SEQ ID Nos. 149, 150, 151; SEQ ID Nos. 153, 154, 155; SEQ ID Nos. 157, 158, 159; SEQ ID Nos. 161, 162, 163; SEQ ID Nos. 165, 166, 167; SEQ ID Nos. 169, 170, 171; SEQ ID Nos. 173, 174, 175; SEQ ID Nos. 177, 178, 179; SEQ ID Nos. 181, 182, 183; SEQ ID Nos. 185, 186, 187; SEQ ID Nos. 189, 190, 191; SEQ ID Nos. 193, 194, 195; SEQ ID Nos. 197, 198, 199; SEQ ID Nos. 201, 202, 203; SEQ ID Nos. 205, 206, 207; SEQ ID Nos. 209, 210, 211; SEQ ID Nos. 213, 214, 215; SEQ ID Nos. 217, 218, 219; SEQ ID Nos. 251, 252, 253; SEQ ID Nos. 255, 256, 257; SEQ ID Nos. 259, 260, 261; SEQ ID Nos. 263, 264, 265; SEQ ID Nos. 267, 268, 269; SEQ ID Nos. 271, 272, 273; SEQ ID Nos. 275, 276, 277; SEQ ID Nos. 279, 280, 281; SEQ ID Nos. 283, 284, 285; SEQ ID Nos. 287, 288, 289; SEQ ID Nos. 291, 292, 293; SEQ ID Nos. 295, 296, 297; SEQ ID Nos. 299, 300, 301; SEQ ID Nos. 303, 304, 305; SEQ ID Nos. 307, 308, 309; SEQ ID Nos. 311, 312, 313; SEQ ID Nos. 315, 316, 317; SEQ ID Nos. 319, 320, 321; SEQ ID Nos. 323, 324, 325; SEQ ID Nos. 327, 328, 329; SEQ ID Nos. 331, 332, 333; SEQ ID Nos. 335, 336, 337; SEQ ID Nos. 339, 340, 341; SEQ ID Nos. 343, 344, 345; SEQ ID Nos. 347, 348, 349; SEQ ID Nos. 351, 352, 353; SEQ ID Nos. 355, 356, 357; SEQ ID Nos. 359, 360, 361; SEQ ID Nos. 363, 364, 365; SEQ ID Nos. 367, 368, 369; SEQ ID Nos. 371, 372, 373; SEQ ID Nos. 375, 376, 377; SEQ ID Nos. 379, 380, 381; SEQ ID Nos. 383, 384, 385; SEQ ID Nos. 387, 388, 389; SEQ ID Nos. 391, 392, 393; SEQ ID Nos. 395, 396, 397; SEQ ID Nos. 399, 400, 401; SEQ ID Nos. 403, 404, 405; SEQ ID Nos. 407, 408, 409; SEQ ID Nos. 411, 412, 413; SEQ ID Nos. 415, 416, 417; SEQ ID Nos. 419, 420, 421; SEQ ID Nos. 423, 424, 425; SEQ ID Nos. 427, 428, 429; SEQ ID Nos. 431, 432, 433; SEQ ID Nos. 435, 436, 437; SEQ ID Nos. 439, 440, 441; SEQ ID Nos. 443, 444, 445; SEQ ID Nos. 447, 448, 449; SEQ ID Nos. 451, 452, 453; SEQ ID Nos. 455, 456, 457 or SEQ ID Nos. 459, 460, 461.

In another embodiment, said CDR1 comprises or consists of the amino acid sequence SEQ ID No. 1 or 251 or a sequence with at least at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% 96%, 97%, 98% or 99% homology thereto. In one embodiment, said CDR2 comprises or consists of the amino acid sequence SEQ ID No. 2 or 252 or a sequence with at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% 96%, 97%, 98% or 99% homology thereto. In one embodiment, said CDR3 comprises or consists of the amino acid sequence SEQ ID No. 3, 176 or 253 or a sequence with at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% 96%, 97%, 98% or 99% homology thereto.

In another embodiment, the first $V_H$ single domain antibody comprises or consists of a polypeptide sequence as shown for any one of $V_H$ single domain antibodies 1.1a to 1.103a as shown in Table 1 or a sequence with at least 60%, 70%, 80%, 90%, 95% or more sequence homology thereto. Thus, the $V_H$ single domain antibody comprises or consists of an amino acid sequence selected from SEQ ID Nos. 4, 8, 12, 16, 20, 24, 28, 32, 36, 40, 44, 48, 52, 56, 60, 64, 68, 72, 76, 80, 104, 108, 112, 116, 120, 124, 128, 132, 136, 140, 144, 148, 152, 156, 160, 164, 168, 172, 176, 180, 184, 188, 192, 196, 200, 204, 208, 212, 216, 220, 254, 258, 262, 266, 270, 274, 278, 282, 286, 290, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, 434, 438, 442, 446, 450, 454, 458 or 462 or a sequence with at least 60%, 70%, 80%, 90%, 95% or more sequence homology thereto. the first $V_H$ single domain antibody comprises or consists of a polypeptide sequence as shown for any one of $V_H$ single domain antibodies 1.20a to1.50a or1.51a and 1.62a to 1.103a as shown in Table 1 or a sequence with at least 60%, 70%, 80%, 90%, 95% or more sequence homology thereto. In one embodiment, the $V_H$ single domain antibody comprises or consists of SEQ ID No. 4, 176, 254, 298 or 446 a sequence with at least 60%, 70%, 80%, 90%, 95% or more sequence homology thereto.

In one embodiment, said sequence homology as above is at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%.

TABLE 1

Full length sequences and CDR sequences of first VH single domain antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.1a | SEQ ID NO: 1 DHAMH | SEQ ID NO: 2 GISWNSGSMGYADSVKD | SEQ ID NO: 3 EKGPGLTGSTADYYGLDV | SEQ ID NO: 4 EVQLLESGGGSVQPGRSLRLSCAASGFTFDDHAMHWVRQAPGKGLEWVSGISWNSGSMGYADSVKDRFTISRDNAKSSLYLQMNSLRAEDTALYYCVREKGPGLTGSTADYYGLDVWGQGTMVTVSS |
| 1.2a | SEQ ID NO: 5 DYAMH | SEQ ID NO: 6 GISWNGGSMGYAASVKG | SEQ ID NO: 7 DKGPGLIGSTADYYGLDV | SEQ ID NO: 8 EVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVKDKGPGLIGSTADYYGLDVWGQGTTVTVSS |
| 1.3a | SEQ ID NO: 9 DYAMH | SEQ ID NO: 10 GISWNSGSMGYADSVKD | SEQ ID NO: 11 DKGPGLIGSTADYHGLDV | SEQ ID NO: 12 EVQLLESGGGLVQPGRSLRLSCAASGFTFDDYAMHWVRQAPGKGREWVSGISWNSGSMGYADSVKDRFTISRDNAKNSLYLQMNSLRAEDTALYYCVKDKGPGLIGSTADYHGLDVWGQGTTVTVSS |
| 1.4a | SEQ ID NO: 13 DYAMH | SEQ ID NO: 14 GISWNGGSMGYAESVKG | SEQ ID NO: 15 DKGPGLTGTTADYYGMDV | SEQ IS NO: 16 EVQLLESGGGLVQPGRSLRLSCAASGFTFADYAMHWVRQAPGKGREWVSGISWNGGSMGYAESVKGRFTISRDNAKNSLYLQMNSLRAEDSALYYCVKDKGPGLTGTTADYYGMDVWGQGTTVTVSS |
| 1.5a | SEQ ID NO: 17 DYAMH | SEQ ID NO: 18 GISWNGGSMGYADSVKD | SEQ ID NO: 19 DKGPGLIGSTADYHGLDV | SEQ ID NO: 20 EVQLVESGGGLVQPGRSLRLSCAASGFTFDDYAMHWVRQAPGKGLEWVSGISWNGGSMGYADSVKDRFTISRDNAKNSLYLQMNRLRAEDTALYYCVKDKGPGLIGSTADYHGLDVWGQGTTVTVSS |
| 1.6a | SEQ ID NO: 21 SYAMH | SEQ ID NO: 22 GISWNSGSMGYAESVKG | SEQ ID NO: 23 DKGPGLTGTTADYYGMDV | SEQ ID NO: 24 EVQLVESGGGVVQPGRSLRLSCAASGFTFSSYAMHWVRQAPGKGREWVSGISWNSGSMGYAESVKGRFTISRDNAKNSLYLQMNSLRAEDSALYYCVKDKGPGLTGTTADYYGMDVWGQGTTVTVSS |
| 1.7a | SEQ ID NO: 25 DYAMH | SEQ ID NO: 26 GISWNGGSMGYAESVKG | SEQ ID NO: 27 DKGPGLTGTTADYYGMDV | SEQ ID NO:28 EVQLVESGGGVIQPGRSLRLSCAASGFTFDDYAMHWVRQAPGKGREWVSGISWNGGSMGYAESVKGRFTISRDNAQNSLYLQMNSLRAEDSALYYCVKDKGPGLTGTTADYYGMDVWGQGTTVTVSS |
| 1.8a | SEQ ID NO: 29 DYAMH | SEQ ID NO: 30 GISWNSGSMGYADSVKD | SEQ ID NO: 31 DKGPGLIGSTADYHGLDV | SEQ ID NO: 32 EVQLVESGGGLVQPGRSLRLSCAASGFTFDDYAMHWVRQAPGKGLEWVSGISWNSGSMGYADSVKDRFTISRDNAKNSLYLQMNSLRAEDTALYYCVKDKGPGLIGSTADYHGLDVWGQGTTVTVSS |
| 1.9a | SEQ ID NO: 33 DYAMH | SEQ ID NO: 34 GISWNGGSMGYAESVKG | SEQ ID NO: 35 DKGPGLIGSTADYYGMDV | SEQ ID NO: 36 EVQLVESGGGCVQPGRSLRISCAASGFTFDDYAMHWVRQAPGKGREWVSGISWNGGSMGYAESVKGRFTISRDNAKNSLYLQMNSLRAEDSALYYCVKDKGPGLIGSTADYYGMDVWGQGTTVTVSS |

TABLE 1-continued

Full length sequences and CDR sequences of first VH single domain antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.10a | SEQ ID NO: 37 DYAMH | SEQ ID NO: 38 GISWNGGSMGYAESVKG | SEQ ID NO: 39 DKGPGLTGTTADYYGMDV | SEQ ID NO: 40 EVQLVESGGGLVQPGRSLRLSCAASGFTFADYAMHWVRQAPGKGREWVSGISWNGGSMGYAESVKGRFTISRDNAKNSLYLQMNSLRAEDSALYYCVKDKGPGLTGTTADYYGMDVWGQGTTVTVSS |
| 1.11a | SEQ ID NO: 41 DYAMH | SEQ ID NO: 42 GISWNGGSMGYAESVKG | SEQ ID NO: 43 DKGPGLIGSTADYYGLDV | SEQ ID NO: 44 EVQLLESGGGFVQPGRSLRISCAASGFTFDDYAMHWVRQAPGKDLEWVSGISWNGGSMGYAESVKGRFTISRDNAKNSLYLKMNSLRVEDTALYYCVKDKGPGLIGSTADYYGLDVWGQGTTVTVSS |
| 1.12a | SEQ ID NO: 45 DYAMH | SEQ ID NO: 46 GISWNGGSMGYADSVKD | SEQ ID NO: 47 DKGPGLTGSTADYHGMDV | SEQ ID NO:48 QVQLVESGGGLVQPGRSLRLSCAASGFTFDDYAMHWVRQAPGKGREWVSGISWNGGSMGYADSVKDRFTISRDNAKNSLYLQMNSLRAEDTALYYCVKDKGPGLTGSTADYHGMDVWGQGTTVTVSS |
| 1.13a | SEQ ID NO: 49 DYAMH | SEQ ID NO: 50 GISWNGGSMGYAASVKG | SEQ ID NO: 51 DKGPGLIGSTADYYGLDV | SEQ ID NO: 52 QVQLVESGGGLVQPGRSLRLSCAASGFTFDDYAMHWVRQAPGKDLEWVSGISWNGGSMGYAASVKGRFTISRDNAQNSLYLQMNSLRAEDTALYYCVKDKGPGLIGSTADYYGLDVWGQGTTVTVSS |
| 1.14a | SEQ ID NO: 53 GYAMH | SEQ ID NO: 54 GISWNSGSMGYAESVKG | SEQ ID NO: 55 DKGPGLTGSTADYYGMDV | SEQ ID NO: 56 EVQLVESGGGLVQPGRSLRLSCAASGFTFDGYAMHWVRQAPGKGREWVSGISWNSGSMGYAESVKGRFTISRDNAKNSLYLQMNSLRAEDSALYYCVKDKGPGLTGSTADYYGMDVWGQGTTVTVSS |
| 1.15a | SEQ ID NO: 57 DYAMH | SEQ ID NO: 58 GISWNSGSMGYAESVKG | SEQ ID NO: 59 DKGPGLIGSTADYYGMDV | SEQ ID NO: 60 EVQLLESGGGLVQPGRSLRLSCTASGFTFDDYAMHWVRQAPGKGREWVSGISWNSGSMGYAESVKGRFTISRDNAKNSLYLQMNSLRAEDSALYYCVKDKGPGLIGSTADYYGMDVWGQGTTVTVSS |
| 1.16a | SEQ ID NO: 61 DYAMH | SEQ ID NO: 62 GISWNGGSMGYAESVKG | SEQ ID NO: 63 DKGPGLIGSTADYYGMDV | SEQ ID NO: 64 QVQLVESGGGLVQPGRSLRLSCAASGFTFDDYAMHWVRQAPGKGREWVSGISWNGGSMGYAESVKGRFTISRDNAKNSLYLQMNSLRAEDSALYYCVKDKGPGLIGSTADYYGMDVWGQGTTVTVSS |
| 1.17a | SEQ ID NO: 65 DYAMH | SEQ ID NO: 66 GISWNSGSMGYAASVKD | SEQ ID NO: 67 DKGPGLIGSTADYHGLDV | SEQ ID NO: 68 EVQLLESGGGLVQPGGSLRLSCAASGFTFDDYAMHWVRQAPGKGLEWVSGISWNSGSMGYAASVKDRFTISRDNAKNSLYLQMNSLTTEDTALYYCVKDKGPGLIGSTADYHGLDVWGQGTTVTVSS |
| 1.18a | SEQ ID NO: 69 DYAMH | SEQ ID NO: 70 GISWNGGSMGYAASVKG | SEQ ID NO: 71 DKGPGLIGSTADYYGLDV | SEQ ID NO: 72 QVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVKDKGPGLIGSTADYYGLDVWGQGTTVTVSS |
| 1.19a | SEQ ID NO: 73 DYAMH | SEQ ID NO: 74 GISWNGGSMGYADSVKG | SEQ ID NO: 75 EKGPGLTGSTADYYGLDV | SEQ ID NO: 76 EVQLVESGGGLVQPGRSLRLSCAASGFTFDDYAMHWVRQAPGKDLEWVSGISWNGGSMGYADSVKGRFTISRDNAKNSLYLQMNSLRAEDTALYYCVREKGPGLTGSTADYYGLDVWGQGTMVTVSS |

TABLE 1-continued

Full length sequences and CDR sequences of first VH single domain antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.20a | SEQ ID NO: 77 DYAMH | SEQ ID NO: 78 GISWNGGSMGYADSVKG | SEQ ID NO: 79 EKGPGLTGSTADYYGLDV | SEQ ID NO: 80 EVQLVESGGGLVQPGRSLRLSCAASGFTFDDYAMHWVRQAPGKDLEWVSGISWNGGSMGYADSVKGRFTISRDNAKNSLYLQMNSLRAEDTALYYCVREKGPGLTGSTADYYGLDVWGQGTMVTVSS |
| 1.21a | SEQ ID NO: 101 DYAMH | SEQ ID NO: 102 GISWNGGSMGYAASVKG | SEQ ID NO: 103 EKGPGLTGSTADYYGLDV | SEQ ID NO: 104 EVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVREKGPGLTGSTADYYGLDVWGQGTMVTVSS |
| 1.22a | SEQ ID NO: 105 DYAMH | SEQ ID NO: 106 GISWNGGSMGYAASVKG | SEQ ID NO: 107 EKGPGLTGSTADYYGLDA | SEQ ID NO: 108 EVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVREKGPGLTGSTADYYGLDAWGQGTMVTVSS |
| 1.23a | SEQ ID NO: 109 DYAMH | SEQ ID NO: 110 GISWNSGSMGYAASVKG | SEQ ID NO: 111 EKGPGLTGSTADYYGLDV | SEQ ID NO: 112 EVQLVESGGGLVQPGRSLRLSCAASGFTFDDYAMHWVRQAPGKDLEWVSGISWNSGSMGYAASVKGRFTISRDNAKNSLYLQMNSLRAEDTALYYCVREKGPGLTGSTADYYGLDVWGQGTMVTVSS |
| 1.24a | SEQ ID NO: 113 DYAMH | SEQ ID NO: 114 GISWNSGSMGYAASVKG | SEQ ID NO: 115 EKGPGLTGSTADYYGLDA | SEQ ID NO: 116 EVQLVESGGGLVQPGRSLRLSCAASGFTFDDYAMHWVRQAPGKDLEWVSGISWNSGSMGYAASVKGRFTISRDNAKNSLYLQMNSLRAEDTALYYCVREKGPGLTGSTADYYGLDAWGQGTMVTVSS |
| 1.25a | SEQ ID NO: 117 DYAMH | SEQ ID NO: 118 GISWNGGSQGYAASVKG | SEQ ID NO: 119 EKGPGLTGSTADYYGLDA | SEQ ID NO: 120 EVQLVESGGGLVQPGRSLRLSCAASGFTFDDYAMHWVRQAPGKDLEWVSGISWNGGSQGYAASVKGRFTISRDNAKNSLYLQMNSLRAEDTALYYCVREKGPGLTGSTADYYGLDAWGQGTMVTVSS |
| 1.26a | SEQ ID NO: 121 DYAMH | SEQ ID NO: 122 GISWNGGSMGYADSVKG | SEQ ID NO: 123 EKGPGLTGSTADYYGLDA | SEQ ID NO: 124 EVQLVESGGGLVQPGRSLRLSCAASGFTFDDYAMHWVRQAPGKDLEWVSGISWNGGSMGYADSVKGRFTISRDNAKNSLYLQMNSLRAEDTALYYCVREKGPGLTGSTADYYGLDAWGQGTMVTVSS |
| 1.27a | SEQ ID NO: 125 DYAMH | SEQ ID NO: 126 GISWNGGSRGYAASVKG | SEQ ID NO: 127 EKGPGLTGSTADYYGLDA | SEQ ID NO: 128 EVQLVESGGGLVQPGRSLRLSCAASGFTFDDYAMHWVRQAPGKDLEWVSGISWNGGSRGYAASVKGRFTISRDNAKNSLYLQMNSLRAEDTALYYCVREKGPGLTGSTADYYGLDAWGQGTMVTVSS |
| 1.28a | SEQ ID NO: 129 DYAMH | SEQ ID NO: 130 GISWNAGSMGYAASVKG | SEQ ID NO: 131 EKGPGLTGSTADYYGLDA | SEQ ID NO: 132 EVQLVESGGGLVQPGRSLRLSCAASGFTFDDYAMHWVRQAPGKDLEWVSGISWNAGSMGYAASVKGRFTISRDNAKNSLYLQMNSLRAEDTALYYCVREKGPGLTGSTADYYGLDAWGQGTMVTVSS |
| 1.29a | SEQ ID NO: 133 DYAMH | SEQ ID NO: 134 GISWNSGSMGYADSVKG | SEQ ID NO: 135 EKGPGLTGSTADYYGLDV | SEQ ID NO: 136 EVQLVESGGGLVQPGRSLRLSCAASGFTFDDYAMHWVRQAPGKDLEWVSGISWNSGSMGYADSVKGRFTISRDNAKNSLYLQMNSLRAEDTALYYCVREKGPGLTGSTADYYGLDVWGQGTMVTVSS |

TABLE 1-continued

Full length sequences and CDR sequences of first VH single domain
antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.30a | SEQ ID NO: 137 DYAGH | SEQ ID NO: 138 GISWNGGSMGYAASVKG | SEQ ID NO: 139 EKGPGLTGSTADYYGLDA | SEQ ID NO: 140 EVQLVESGGGLVQPGRSLRLSCAASGFTFDDYAGHWVRQAPGKDLEWVSGISWNGGSMGYAASVKGRFTISRDNAKNSLYLQMNSLRAEDTALYYCVREKGPGLTGSTADYYGLDAWGQGTMVTVSS |
| 1.31a | SEQ ID NO: 141 DYALH | SEQ ID NO: 142 GISWNGGSMGYAASVKG | SEQ ID NO: 143 EKGPGLTGSTADYYGLDA | SEQ ID NO: 144 EVQLVESGGGLVQPGRSLRLSCAASGFTFDDYALHWVRQAPGKDLEWVSGISWNGGSMGYAASVKGRFTISRDNAKNSLYLQMNSLRAEDTALYYCVREKGPGLTGSTADYYGLDAWGQGTMVTVSS |
| 1.32a | SEQ ID NO: 145 DYAMH | SEQ ID NO: 146 GISWNSGSMGYADSVKG | SEQ ID NO: 147 EKGPGLTGSTADYYGLDA | SEQ ID NO: 148 EVQLVESGGGLVQPGRSLRLSCAASGFTFDDYAMHWVRQAPGKDLEWVSGISWNSGSMGYADSVKGRFTISRDNAKNSLYLQMNSLRAEDTALYYCVREKGPGLTGSTADYYGLDAWGQGTMVTVSS |
| 1.33a | SEQ ID NO: 149 DYAMH | SEQ ID NO: 150 GISWNGGSYGYADSVKG | SEQ ID NO: 151 EKGPGLTGSTADYYGLDA | SEQ ID NO: 152 EVQLVESGGGLVQPGRSLRLSCAASGFTFDDYAMHWVRQAPGKDLEWVSGISWNGGSYGYADSVKGRFTISRDNAKNSLYLQMNSLRAEDTALYYCVREKGPGLTGSTADYYGLDAWGQGTMVTVSS |
| 1.34a | SEQ ID NO: 153 DYAMH | SEQ ID NO: 154 GISWNGGSQGYADSVKG | SEQ ID NO: 155 EKGPGLTGSTADYYGLDA | SEQ ID NO: 156 EVQLVESGGGLVQPGRSLRLSCAASGFTFDDYAMHWVRQAPGKDLEWVSGISWNGGSQGYADSVKGRFTISRDNAKNSLYLQMNSLRAEDTALYYCVREKGPGLTGSTADYYGLDAWGQGTMVTVSS |
| 1.35a | SEQ ID NO: 157 DYAMH | SEQ ID NO: 158 GISWNGGSKGYADSVKG | SEQ ID NO: 159 EKGPGLTGSTADYYGLDA | SEQ ID NO: 160 EVQLVESGGGLVQPGRSLRLSCAASGFTFDDYAMHWVRQAPGKDLEWVSGISWNGGSKGYADSVKGRFTISRDNAKNSLYLQMNSLRAEDTALYYCVREKGPGLTGSTADYYGLDAWGQGTMVTVSS |
| 1.36a | SEQ ID NO: 161 DYAMH | SEQ ID NO: 162 GISWNAGSMGYADSVKG | SEQ ID NO: 163 EKGPGLTGSTADYYGLDA | SEQ ID NO: 164 EVQLVESGGGLVQPGRSLRLSCAASGFTFDDYAMHWVRQAPGKDLEWVSGISWNAGSMGYADSVKGRFTISRDNAKNSLYLQMNSLRAEDTALYYCVREKGPGLTGSTADYYGLDAWGQGTMVTVSS |
| 1.37a | SEQ ID NO: 165 DYAFH | SEQ ID NO: 166 GISWNGGSMGYADSVKG | SEQ ID NO: 167 EKGPGLTGSTADYYGLDA | SEQ ID NO: 168 EVQLVESGGGLVQPGRSLRLSCAASGFTFDDYAFHWVRQAPGKDLEWVSGISWNGGSMGYADSVKGRFTISRDNAKNSLYLQMNSLRAEDTALYYCVREKGPGLTGSTADYYGLDAWGQGTMVTVSS |
| 1.38a | SEQ ID NO: 169 DYALH | SEQ ID NO: 170 GISWNGGSMGYADSVKG | SEQ ID NO: 171 EKGPGLTGSTADYYGLDA | SEQ ID NO: 172 EVQLVESGGGLVQPGRSLRLSCAASGFTFDDYALHWVRQAPGKDLEWVSGISWNGGSMGYADSVKGRFTISRDNAKNSLYLQMNSLRAEDTALYYCVREKGPGLTGSTADYYGLDAWGQGTMVTVSS |
| 1.39a | SEQ ID NO: 173 DYALH | SEQ ID NO: 174 GISWNGGSYGYADSVKG | SEQ ID NO: 175 EKGPGLTGSTADYYGLDA | SEQ ID NO: 176 EVQLVESGGGLVQPGRSLRLSCAASGFTFDDYALHWVRQAPGKDLEWVSGISWNGGSYGYADSVKGRFTISRDNAKNSLYLQMNSLRAEDTALYYCVREKGPGLTGSTADYYGLDAWGQGTMVTVSS |

TABLE 1-continued

Full length sequences and CDR sequences of first VH single domain
antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.40a | SEQ ID NO: 177 DYALH | SEQ ID NO: 178 GISWNG GSQGYA DSVKG | SEQ ID NO: 179 EKGPGLT GSTADYY GLDA | SEQ ID NO: 180 EVQLVESGGGLVQPGRSLRLSCAASG FTFDDYALHWVRQAPGKDLEWVSGIS WNGGSQGYADSVKGRFTISRDNAKNS LYLQMNSLRAEDTALYYCVREKGPGLT GSTADYYGLDAWGQGTMVTVSS |
| 1.41a | SEQ ID NO: 181 DYAFH | SEQ ID NO: 182 GISWNG GSYGYA DSVKG | SEQ ID NO: 183 EKGPGLT GSTADYY GLDA | SEQ ID NO: 184 EVQLVESGGGLVQPGRSLRLSCAASG FTFDDYAFHWVRQAPGKDLEWVSGIS WNGGSYGYADSVKGRFTISRDNAKNS LYLQMNSLRAEDTALYYCVREKGPGLT GSTADYYGLDAWGQGTMVTVSS |
| 1.42a | SEQ ID NO: 185 DYAFH | SEQ ID NO: 186 GISWNG GSQGYA DSVKG | SEQ ID NO: 187 EKGPGLT GSTADYY GLDA | SEQ ID NO: 188 EVQLVESGGGLVQPGRSLRLSCAASG FTFDDYAFHWVRQAPGKDLEWVSGIS WNGGSQGYADSVKGRFTISRDNAKNS LYLQMNSLRAEDTALYYCVREKGPGLT GSTADYYGLDAWGQGTMVTVSS |
| 1.43a | SEQ ID NO: 189 DYAFH | SEQ ID NO: 190 GISWNA GSYGYA DSVKG | SEQ ID NO: 191 EKGPGLT GSTADYY GLDA | SEQ ID NO: 192 EVQLVESGGGLVQPGRSLRLSCAASG FTFDDYAFHWVRQAPGKDLEWVSGIS WNAGSYGYADSVKGRFTISRDNAKNS LYLQMNSLRAEDTALYYCVREKGPGLT GSTADYYGLDAWGQGTMVTVSS |
| 1.44a | SEQ ID NO: 193 DYALH | SEQ ID NO: 194 GISWNS GSYGYA DSVKG | SEQ ID NO: 195 EKGPGLT GSTADYY GLDA | SEQ ID NO: 196 EVQLVESGGGLVQPGRSLRLSCAASG FTFDDYALHWVRQAPGKDLEWVSGIS WNSGSYGYADSVKGRFTISRDNAKNS LYLQMNSLRAEDTALYYCVREKGPGLT GSTADYYGLDAWGQGTMVTVSS |
| 1.45a | SEQ ID NO: 197 DYALH | SEQ ID NO: 198 GISWNA GSQGYA DSVKG | SEQ ID NO: 199 EKGPGLT GSTADYY GLDA | SEQ ID NO: 200 EVQLVESGGGLVQPGRSLRLSCAASG FTFDDYALHWVRQAPGKDLEWVSGIS WNAGSQGYADSVKGRFTISRDNAKNS LYLQMNSLRAEDTALYYCVREKGPGLT GSTADYYGLDAWGQGTMVTVSS |
| 1.46a | SEQ ID NO: 201 DYALH | SEQ ID NO: 202 GISWNA GSYGYA DSVKG | SEQ ID NO: 203 EKGPGLT GSTADYY GLDA | SEQ ID NO: 204 EVQLVESGGGLVQPGRSLRLSCAASG FTFDDYALHWVRQAPGKDLEWVSGIS WNAGSYGYADSVKGRFTISRDNAKNS LYLQMNSLRAEDTALYYCVREKGPGLT GSTADYYGLDAWGQGTMVTVSS |
| 1.47a | SEQ ID NO: 205 DYAFH | SEQ ID NO: 206 GISWNS GSYGYA DSVKG | SEQ ID NO: 207 EKGPGLT GSTADYY GLDA | SEQ ID NO: 208 EVQLVESGGGLVQPGRSLRLSCAASG FTFDDYAFHWVRQAPGKDLEWVSGIS WNSGSYGYADSVKGRFTISRDNAKNS LYLQMNSLRAEDTALYYCVREKGPGLT GSTADYYGLDAWGQGTMVTVSS |
| 1.48a | SEQ ID NO: 209 DYALH | SEQ ID NO: 210 GISWNS GSQGYA DSVKG | SEQ ID NO: 211 EKGPGLT GSTADYY GLDA | SEQ ID NO: 212 EVQLVESGGGLVQPGRSLRLSCAASG FTFDDYALHWVRQAPGKDLEWVSGIS WNSGSQGYADSVKGRFTISRDNAKNS LYLQMNSLRAEDTALYYCVREKGPGLT GSTADYYGLDAWGQGTMVTVSS |
| 1.49a | SEQ ID NO: 213 DYAFH | SEQ ID NO: 214 GISWNS GSQGYA DSVKG | SEQ ID NO: 215 EKGPGLT GSTADYY GLDA | SEQ ID NO: 216 EVQLVESGGGLVQPGRSLRLSCAASG FTFDDYAFHWVRQAPGKDLEWVSGIS WNSGSQGYADSVKGRFTISRDNAKNS LYLQMNSLRAEDTALYYCVREKGPGLT GSTADYYGLDAWGQGTMVTVSS |

TABLE 1-continued

Full length sequences and CDR sequences of first VH single domain antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.50a | SEQ ID NO: 217 DYAFH | SEQ ID NO: 218 GISWNAGSQGYADSVKG | SEQ ID NO: 219 EKGPGLTGSTADYYGLDA | SEQ ID NO: 220 EVQLVESGGGLVQPGRSLRLSCAASG FTFDDYAFHWVRQAPGKDLEWVSGIS WNAGSQGYADSVKGRFTISRDNAKNS LYLQMNSLRAEDTALYYCVREKGPGLT GSTADYYGLDAWGQGTMVTVSS |
| 1.51a | SEQ ID NO: 251 DYAMS | SEQ ID NO: 252 GITWNGGSTGYADSVKD | SEQ ID NO: 253 DKYSYAWSYDGFDI | SEQ ID NO: 254 EVQLVESGGGVVRPGGSLRLSCAASG FTFDDYAMSWVRQAPGKGLEWVSGIT WNGGSTGYADSVKDRFTISRDNAKNS LYLQMNSLRAEDTALYYCVRDKYSYA WSYDGFDIWGQGTMVTVSS |
| 1.52a | SEQ ID NO: 255 DYGMS | SEQ ID NO: 256 GISRNGGSAGYSDSAKD | SEQ ID NO: 257 EKYSSGWSYDDFDI | SEQ ID NO: 258 EVQLLESGGGVVRPGGSLRLSCAASG FTFDDYGMSWVRQPPGKGLEWVSGIS RNGGSAGYSDSAKDRFTISRDNAKNSL YLQMNSLRADDTAMYYCAREKYSSGW SYDDFDIWGQGTMVTVSS |
| 1.53a | SEQ ID NO: 259 DYGMS | SEQ ID NO: 260 GISRNGGSAGYSDSAKD | SEQ ID NO: 261 EKYSSGWSYDDFDI | SEQ ID NO: 262 QVQLVESGGGVVRPGGSLRLSCAASG FTFDDYGMSWVRQSPGKGLEWVSGIS RNGGSAGYSDSAKDRFTISRDNAKNSL YLQMNSLRADDTAMYYCAREKYSSGW SYDDFDIWGQGTMVTVSS |
| 1.54a | SEQ ID NO: 263 DYGMS | SEQ ID NO: 264 GISRNGGSAGYSDSAKD | SEQ ID NO: 265 EKYSSGWSYDDFDI | SEQ ID NO: 266 QVQLVESGGGVVRPGGSLRLSCAASG FTFDDYGMSWVRQPPGKGLEWVSGIS RNGGSAGYSDSAKDRFTISRDNAKNSL YLQMNSLRADDTAMYYCAREKYSSGW SYDDFDIWGQGTMVTVSS |
| 1.55a | SEQ ID NO: 267 DYGMS | SEQ ID NO: 268 GISRNGGSAGYSDSAKD | SEQ ID NO: 269 EKYSSGWSYDDFDI | SEQ ID NO: 270 EVQLVESGGGVVRPGGSLRLSCAASG FTFDDYGMSWVRQPPGKGLEWVSGIS RNGGSAGYSDSAKDRFTISRDNAKNSL YLQMNSLRADDTAMYYCAREKYSSGW SYDDFDIWGQGTMVTVSS |
| 1.56a | SEQ ID NO: 271 DYGMS | SEQ ID NO: 272 GISRNGGSTGYADSVKD | SEQ ID NO: 273 DPYSSGWSYDSFDI | SEQ ID NO: 274 QVQLVESGGGVVRLGGSLRLSCAASG FSFVDYGMSWVRQAPGQGLEWVSGIS RNGGSTGYADSVKDRFTISRDNAKNTL YLQMNSLRAEDTALYYCARDPYSSGW SYDSFDIWGQGTMVTVSS |
| 1.57a | SEQ ID NO: 275 DYGMS | SEQ ID NO: 276 GISRNGGSTGYTASVKD | SEQ ID NO: 277 EKYSSGWSYDDFDI | SEQ ID NO: 278 QVQLVESGGGVVRPGGSLRLSCAASG FTFDDYGMSWVRQAPGKGLEWVSGIS RNGGSTGYTASVKDRFTISRDNAKNSL YLQMNSLRADDTAMYYCAREKYSSGW SYDDFDIWGQGTMVTVSS |
| 1.58a | SEQ ID NO: 279 DYAMS | SEQ ID NO: 280 GISWNGGSAGYADSVKD | SEQ ID NO: 281 DPHSSAWSYDAFDI | SEQ ID NO: 282 QVQLVESGGGLVQPGGSLRLSCAASG FTFDDYAMSWVRQAPGKGLEWVSGIS WNGGSAGYADSVKDRFTISRDNAKNS LYLQMNSLRAEDTALYYCARDPHSSA WSYDAFDIWGQGTMVTVSS |
| 1.59a | SEQ ID NO: 283 DYAMS | SEQ ID NO: 284 GISWNGGSKGYADSVKD | SEQ ID NO: 285 DPYSGAWSYDAFDI | SEQ ID NO: 286 QVQLVESGGGVVRPGGSLRLSCAASG FTFDDYAMSWVRQAPGKGLEWVSGIS WNGGSKGYADSVKDRFTISRDNAKNS LYLQMNSLRAEDTALYYCARDPYSGA WSYDAFDIWGQGTMVTVSS |

TABLE 1-continued

Full length sequences and CDR sequences of first VH single domain antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.60a | SEQ ID NO: 287 DYAMS | SEQ ID NO: 288 GISWNGGSTGYADSVKD | SEQ ID NO: 289 DPYSGAWSYDAFDI | SEQ ID NO: 290 QVQLVESGGGVVRPGGSLRLSCAASGFTFDDYAMSWVRQAPGKGLEWVSGISWNGGSTGYADSVKDRFTISRDNAKNSLYLQMNSLRAEDTALYYCARDPYSGAWSYDAFDIWGQGTMVTVSS |
| 1.61a | SEQ ID NO: 291 NYAMS | SEQ ID NO: 292 GITWNGGSTGYADSVKD | SEQ ID NO: 293 DKYSYAWSYDTFDI | SEQ ID NO: 294 QVQLVESGGGVVRPGGSLRLSCAASGFTFDNYAMSWVRQAPGKGLEWVSGITWNGGSTGYADSVKDRFTISRDNAKNSLYLQMNSLRAEDTALYYCARDKYSYAWSYDTFDIRGQGTMVTVSS |
| 1.62a | SEQ ID NO: 295 DYAMS | SEQ ID NO: 296 GITWNAGSTGYADSVKG | SEQ ID NO: 297 DKYSYAWSYDDFDI | SEQ ID NO: 298 EVQLVESGGGVVRPGGSLRLSCAASGFTFDDYAMSWVRQAPGKGLEWVSGITWNAGSTGYADSVKGRFTISRDNAKNSLYLQMNSLRAEDTALYYCVRDKYSYAWSYDDFDIWGQGTMVTVSS |
| 1.63a | SEQ ID NO: 299 DYAMS | SEQ ID NO: 300 GITWNRGSTGYADSVKG | SEQ ID NO: 301 DKYSYAWSYDDFDI | SEQ ID NO: 302 EVQLVESGGGVVRPGGSLRLSCAASGFTFDDYAMSWVRQAPGKGLEWVSGITWNRGSTGYADSVKGRFTISRDNAKNSLYLQMNSLRAEDTALYYCVRDKYSYAWSYDDFDIWGQGTMVTVSS |
| 1.64a | SEQ ID NO: 303 DYAFS | SEQ ID NO: 304 GITWNGGSTGYADSVKG | SEQ ID NO: 305 DKYSYAWSYDGFDI | SEQ ID NO: 306 EVQLVESGGGVVRPGGSLRLSCAASGFTFDDYAFSWVRQAPGKGLEWVSGITWNGGSTGYADSVKGRFTISRDNAKNSLYLQMNSLRAEDTALYYCVRDKYSYAWSYDGFDIWGQGTMVTVSS |
| 1.65a | SEQ ID NO: 307 DYAQS | SEQ ID NO: 308 GITWNGGSTGYADSVKG | SEQ ID NO: 309 DKYSYAWSYDGFDI | SEQ ID NO: 310 EVQLVESGGGVVRPGGSLRLSCAASGFTFDDYAQSWVRQAPGKGLEWVSGITWNGGSTGYADSVKGRFTISRDNAKNSLYLQMNSLRAEDTALYYCVRDKYSYAWSYDGFDIWGQGTMVTVSS |
| 1.66a | SEQ ID NO: 311 DYANS | SEQ ID NO: 312 GITWNGGSTGYADSVKG | SEQ ID NO: 313 DKYSYAWSYDGFDI | SEQ ID NO: 314 EVQLVESGGGVVRPGGSLRLSCAASGFTFDDYANSWVRQAPGKGLEWVSGITWNGGSTGYADSVKGRFTISRDNAKNSLYLQMNSLRAEDTALYYCVRDKYSYAWSYDGFDIWGQGTMVTVSS |
| 1.67a | SEQ ID NO: 315 DYAGS | SEQ ID NO: 316 GITWNGGSTGYADSVKG | SEQ ID NO: 317 DKYSYAWSYDGFDI | SEQ ID NO: 318 EVQLVESGGGVVRPGGSLRLSCAASGFTFDDYAGSWVRQAPGKGLEWVSGITWNGGSTGYADSVKGRFTISRDNAKNSLYLQMNSLRAEDTALYYCVRDKYSYAWSYDGFDIWGQGTMVTVSS |
| 1.68a | SEQ ID NO: 319 DYAES | SEQ ID NO: 320 GITWNGGSTGYADSVKG | SEQ ID NO: 321 DKYSYAWSYDGFDI | SEQ ID NO: 322 EVQLVESGGGVVRPGGSLRLSCAASGFTFDDYAESWVRQAPGKGLEWVSGITWNGGSTGYADSVKGRFTISRDNAKNSLYLQMNSLRAEDTALYYCVRDKYSYAWSYDGFDIWGQGTMVTVSS |
| 1.69a | SEQ ID NO: 323 DYAWS | SEQ ID NO: 324 GITWNGGSTGYADSVKG | SEQ ID NO: 325 DKYSYAWSYDGFDI | SEQ ID NO: 326 EVQLVESGGGVVRPGGSLRLSCAASGFTFDDYAWSWVRQAPGKGLEWVSGITWNGGSTGYADSVKGRFTISRDNAKNSLYLQMNSLRAEDTALYYCVRDKYSYAWSYDGFDIWGQGTMVTVSS |

TABLE 1-continued

Full length sequences and CDR sequences of first VH single domain antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.70a | SEQ ID NO: 327 DYAVS | SEQ ID NO: 328 GITWNG GSTGYA DSVKG | SEQ ID NO: 329 DKYSYAW SYDGFDI | SEQ ID NO: 330 EVQLVESGGGVVRPGGSLRLSCAASG FTFDDYAVSWVRQAPGKGLEWVSGIT WNGGSTGYADSVKGRFTISRDNAKNS LYLQMNSLRAEDTALYYCVRDKYSYA WSYDGFDIWGQGTMVTVSS |
| 1.71a | SEQ ID NO: 331 DYALS | SEQ ID NO: 332 GITWNG GSTGYA DSVKG | SEQ ID NO: 333 DKYSYAW SYDGFDI | SEQ ID NO: 334 EVQLVESGGGVVRPGGSLRLSCAASG FTFDDYALSWVRQAPGKGLEWVSGIT WNGGSTGYADSVKGRFTISRDNAKNS LYLQMNSLRAEDTALYYCVRDKYSYA WSYDGFDIWGQGTMVTVSS |
| 1.72a | SEQ ID NO: 335 DYASS | SEQ ID NO: 336 GITWNG GSTGYA DSVKG | SEQ ID NO: 337 DKYSYAW SYDGFDI | SEQ ID NO: 338 EVQLVESGGGVVRPGGSLRLSCAASG FTFDDYASSWVRQAPGKGLEWVSGIT WNGGSTGYADSVKGRFTISRDNAKNS LYLQMNSLRAEDTALYYCVRDKYSYA WSYDGFDIWGQGTMVTVSS |
| 1.73a | SEQ ID NO: 339 DYARS | SEQ ID NO: 340 GITWNG GSTGYA DSVKG | SEQ ID NO: 341 DKYSYAW SYDGFDI | SEQ ID NO: 342 EVQLVESGGGVVRPGGSLRLSCAASG FTFDDYARSWVRQAPGKGLEWVSGIT WNGGSTGYADSVKGRFTISRDNAKNS LYLQMNSLRAEDTALYYCVRDKYSYA WSYDGFDIWGQGTMVTVSS |
| 1.74a | SEQ ID NO: 343 DYAMS | SEQ ID NO: 344 GITWNSG STGYADS VKD | SEQ ID NO: 345 DKYSYAW SYDDFDI | SEQ ID NO: 346 EVQLVESGGGVVRPGGSLRLSCAASG FTFDDYAMSWVRQAPGKGLEWVSGIT WNSGSTGYADSVKDRFTISRDNAKNS LYLQMNSLRAEDTALYYCVRDKYSYA WSYDDFDIWGQGTMVTVSS |
| 1.75a | SEQ ID NO: 347 DYAMS | SEQ ID NO: 348 GITWNQ GSTGYA DSVKD | SEQ ID NO: 349 DKYSYAW SYDDFDI | SEQ ID NO: 350 EVQLVESGGGVVRPGGSLRLSCAASG FTFDDYAMSWVRQAPGKGLEWVSGIT WNQGSTGYADSVKDRFTISRDNAKNS LYLQMNSLRAEDTALYYCVRDKYSYA WSYDDFDIWGQGTMVTVSS |
| 1.76a | SEQ ID NO: 351 DYAMS | SEQ ID NO: 352 GITWNH GSTGYA DSVKD | SEQ ID NO: 353 DKYSYAW SYDVFDI | SEQ ID NO: 354 EVQLVESGGGVVRPGGSLRLSCAASG FTFDDYAMSWVRQAPGKGLEWVSGIT WNHGSTGYADSVKDRFTISRDNAKNS LYLQMNSLRAEDTALYYCVRDKYSYA WSYDVFDIWGQGTMVTVSS |
| 1.77a | SEQ ID NO: 355 DYAMS | SEQ ID NO: 356 GITWNAG STGYADS VKD | SEQ ID NO: 357 DKYSYAW SYDDFDI | SEQ ID NO: 358 EVQLVESGGGVVRPGGSLRLSCAASG FTFDDYAMSWVRQAPGKGLEWVSGIT WNAGSTGYADSVKDRFTISRDNAKNS LYLQMNSLRAEDTALYYCVRDKYSYA WSYDDFDIWGQGTMVTVSS |
| 1.78a | SEQ ID NO: 359 DYAMS | SEQ ID NO: 360 GITWNG GSTGYA DSVKG | SEQ ID NO: 361 DKYSYAW SYDVFDI | SEQ ID NO: 362 EVQLVESGGGVVRPGGSLRLSCAASG FTFDDYAMSWVRQAPGKGLEWVSGIT WNGGSTGYADSVKGRFTISRDNAKNS LYLQMNSLRAEDTALYYCVRDKYSYA WSYDVFDIWGQGTMVTVSS |
| 1.79a | SEQ ID NO: 363 DYAMS | SEQ ID NO: 364 GITWNG GSTGYA DSVKG | SEQ ID NO: 365 DKYSYAW SYDDFDI | SEQ ID NO: 366 EVQLVESGGGVVRPGGSLRLSCAASG FTFDDYAMSWVRQAPGKGLEWVSGIT WNGGSTGYADSVKGRFTISRDNAKNS LYLQMNSLRAEDTALYYCVRDKYSYA WSYDDFDIWGQGTMVTVSS |

TABLE 1-continued

Full length sequences and CDR sequences of first VH single domain
antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.80a | SEQ ID NO: 367 DYAMS | SEQ ID NO: 368 GITWNKGSTGYADSVKD | SEQ ID NO: 369 DKYSYAWSYDDFDI | SEQ ID NO: 370 EVQLVESGGGVVRPGGSLRLSCAASG FTFDDYAMSWVRQAPGKGLEWVSGIT WNKGSTGYADSVKDRFTISRDNAKNS LYLQMNSLRAEDTALYYCVRDKYSYA WSYDDFDIWGQGTMVTVSS |
| 1.81a | SEQ ID NO: 371 DYAMS | SEQ ID NO: 372 GITWNRGSTGYADSVKD | SEQ ID NO: 373 DKYSYAWSYDDFDI | SEQ ID NO: 374 EVQLVESGGGVVRPGGSLRLSCAASG FTFDDYAMSWVRQAPGKGLEWVSGIT WNRGSTGYADSVKDRFTISRDNAKNS LYLQMNSLRAEDTALYYCVRDKYSYA WSYDDFDIWGQGTMVTVSS |
| 1.82a | SEQ ID NO: 375 DYAIS | SEQ ID NO: 376 GITWNGGSTGYADSVKD | SEQ ID NO: 377 DKYSYAWSYDGFDI | SEQ ID NO: 378 EVQLVESGGGVVRPGGSLRLSCAASG FTFDDYAISWVRQAPGKGLEWVSGIT WNGGSTGYADSVKDRFTISRDNAKNS LYLQMNSLRAEDTALYYCVRDKYSYA WSYDGFDIWGQGTMVTVSS |
| 1.83a | SEQ ID NO: 379 DYATS | SEQ ID NO: 380 GITWNGGSTGYADSVKD | SEQ ID NO: 381 DKYSYAWSYDGFDI | SEQ ID NO: 382 EVQLVESGGGVVRPGGSLRLSCAASG FTFDDYATSWVRQAPGKGLEWVSGIT WNGGSTGYADSVKDRFTISRDNAKNS LYLQMNSLRAEDTALYYCVRDKYSYA WSYDGFDIWGQGTMVTVSS |
| 1.84a | SEQ ID NO: 383 DYANS | SEQ ID NO: 384 GITWNGGSTGYADSVKD | SEQ ID NO: 385 DKYSYAWSYDGFDI | SEQ ID NO: 386 EVQLVESGGGVVRPGGSLRLSCAASG FTFDDYANSWVRQAPGKGLEWVSGIT WNGGSTGYADSVKDRFTISRDNAKNS LYLQMNSLRAEDTALYYCVRDKYSYA WSYDGFDIWGQGTMVTVSS |
| 1.85a | SEQ ID NO: 387 DYADS | SEQ ID NO: 388 GITWNGGSTGYADSVKD | SEQ ID NO: 389 DKYSYAWSYDGFDI | SEQ ID NO: 390 EVQLVESGGGVVRPGGSLRLSCAASG FTFDDYADSWVRQAPGKGLEWVSGIT WNGGSTGYADSVKDRFTISRDNAKNS LYLQMNSLRAEDTALYYCVRDKYSYA WSYDGFDIWGQGTMVTVSS |
| 1.86a | SEQ ID NO: 391 DYASS | SEQ ID NO: 392 GITWNGGSTGYADSVKD | SEQ ID NO: 393 DKYSYAWSYDGFDI | SEQ ID NO: 394 EVQLVESGGGVVRPGGSLRLSCAASG FTFDDYASSWVRQAPGKGLEWVSGIT WNGGSTGYADSVKDRFTISRDNAKNS LYLQMNSLRAEDTALYYCVRDKYSYA WSYDGFDIWGQGTMVTVSS |
| 1.87a | SEQ ID NO: 395 DYALS | SEQ ID NO: 396 GITWNGGSTGYADSVKD | SEQ ID NO: 397 DKYSYAWSYDGFDI | SEQ ID NO: 398 EVQLVESGGGVVRPGGSLRLSCAASG FTFDDYALSWVRQAPGKGLEWVSGIT WNGGSTGYADSVKDRFTISRDNAKNS LYLQM NSLRAEDTALYYCVRDKYSYA WSYDGFDIWGQGTMVTVSS |
| 1.88a | SEQ ID NO: 399 DYAGS | SEQ ID NO: 400 GITWNGGSTGYADSVKD | SEQ ID NO: 401 DKYSYAWSYDGFDI | SEQ ID NO: 402 EVQLVESGGGVVRPGGSLRLSCAASG FTFDDYAGSWVRQAPGKGLEWVSGIT WNGGSTGYADSVKDRFTISRDNAKNS LYLQMNSLRAEDTALYYCVRDKYSYA WSYDGFDIWGQGTMVTVSS |
| 1.89a | SEQ ID NO: 403 DYAES | SEQ ID NO: 404 GITWNGGSTGYADSVKD | SEQ ID NO: 405 DKYSYAWSYDGFDI | SEQ ID NO: 406 EVQLVESGGGVVRPGGSLRLSCAASG FTFDDYAESWVRQAPGKGLEWVSGIT WNGGSTGYADSVKDRFTISRDNAKNS LYLQMNSLRAEDTALYYCVRDKYSYA WSYDGFDIWGQGTMVTVSS |

TABLE 1-continued

Full length sequences and CDR sequences of first VH single domain antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.90a | SEQ ID NO: 407 DYAWS | SEQ ID NO: 408 GITWNGGSTGYADSVKD | SEQ ID NO: 409 DKYSYAWSYDGFDI | SEQ ID NO: 410 EVQLVESGGGVVRPGGSLRLSCAASGFTFDDYAWSWVRQAPGKGLEWVSGITWNGGSTGYADSVKDRFTISRDNAKNSLYLQMNSLRAEDTALYYCVRDKYSYAWSYDGFDIWGQGTMVTVSS |
| 1.91a | SEQ ID NO: 411 DYARS | SEQ ID NO: 412 GITWNGGSTGYADSVKD | SEQ ID NO: 413 DKYSYAWSYDGFDI | SEQ ID NO: 414 EVQLVESGGGVVRPGGSLRLSCAASGFTFDDYARSWVRQAPGKGLEWVSGITWNGGSTGYADSVKDRFTISRDNAKNSLYLQMNSLRAEDTALYYCVRDKYSYAWSYDGFDIWGQGTMVTVSS |
| 1.92a | SEQ ID NO: 415 DYAFS | SEQ ID NO: 416 GITWNGGSTGYADSVKD | SEQ ID NO: 417 DKYSYAWSYDGFDI | SEQ ID NO: 418 EVQLVESGGGVVRPGGSLRLSCAASGFTFDDYAFSWVRQAPGKGLEWVSGITWNGGSTGYADSVKDRFTISRDNAKNSLYLQMNSLRAEDTALYYCVRDKYSYAWSYDGFDIWGQGTMVTVSS |
| 1.93a | SEQ ID NO: 419 DYAVS | SEQ ID NO: 420 GITWNGGSTGYADSVKD | SEQ ID NO: 421 DKYSYAWSYDGFDI | SEQ ID NO: 422 EVQLVESGGGVVRPGGSLRLSCAASGFTFDDYAVSWVRQAPGKGLEWVSGITWNGGSTGYADSVKDRFTISRDNAKNSLYLQMNSLRAEDTALYYCVRDKYSYAWSYDGFDIWGQGTMVTVSS |
| 1.94a | SEQ ID NO: 423 DYAMS | SEQ ID NO: 424 GITWTGGSTGYADSVKD | SEQ ID NO: 425 DKYSYAWSYDGFDI | SEQ ID NO: 426 EVQLVESGGGVVRPGGSLRLSCAASGFTFDDYAMSWVRQAPGKGLEWVSGITVVTGGSTGYADSVKDRFTISRDNAKNSLYLQMNSLRAEDTALYYCVRDKYSYAWSYDGFDIWGQGTMVTVSS |
| 1.95a | SEQ ID NO: 427 DYAMS | SEQ ID NO: 428 GITWSGGSTGYADSVKD | SEQ ID NO: 429 DKYSYAWSYDGFDI | SEQ ID NO: 430 EVQLVESGGGVVRPGGSLRLSCAASGFTFDDYAMSWVRQAPGKGLEWVSGITWSGGSTGYADSVKDRFTISRDNAKNSLYLQMNSLRAEDTALYYCVRDKYSYAWSYDGFDIWGQGTMVTVSS |
| 1.96a | SEQ ID NO: 431 DYAMS | SEQ ID NO: 432 GITWPGGSTGYADSVKD | SEQ ID NO: 433 DKYSYAWSYDGFDI | SEQ ID NO: 434 EVQLVESGGGVVRPGGSLRLSCAASGFTFDDYAMSWVRQAPGKGLEWVSGITWPGGSTGYADSVKDRFTISRDNAKNSLYLQMNSLRAEDTALYYCVRDKYSYAWSYDGFDIWGQGTMVTVSS |
| 1.97a | SEQ ID NO: 435 DYAMS | SEQ ID NO: 436 GITWIGGSTGYADSVKD | SEQ ID NO: 437 DKYSYAWSYDGFDI | SEQ ID NO: 438 EVQLVESGGGVVRPGGSLRLSCAASGFTFDDYAMSWVRQAPGKGLEWVSGITWIGGSTGYADSVKDRFTISRDNAKNSLYLQMNSLRAEDTALYYCVRDKYSYAWSYDGFDIWGQGTMVTVSS |
| 1.98a | SEQ ID NO: 439 DYAMS | SEQ ID NO: 440 GITWLGGSTGYADSVKD | SEQ ID NO: 441 DKYSYAWSYDGFDI | SEQ ID NO: 442 EVQLVESGGGVVRPGGSLRLSCAASGFTFDDYAMSWVRQAPGKGLEWVSGITWLGGSTGYADSVKDRFTISRDNAKNSLYLQMNSLRAEDTALYYCVRDKYSYAWSYDGFDIWGQGTMVTVSS |
| 1.99a | SEQ ID NO: 443 DYAMS | SEQ ID NO: 444 GITWNGGSTGYADSVKG | SEQ ID NO: 445 DKYSYAWSYDGFDI | SEQ ID NO: 446 EVQLVESGGGVVRPGGSLRLSCAASGFTFDDYAMSWVRQAPGKGLEWVSGITWNGGSTGYADSVKGRFTISRDNAKNSLYLQMNSLRAEDTALYYCVRDKYSYAWSYDGFDIWGQGTMVTVSS |

TABLE 1-continued

Full length sequences and CDR sequences of first VH single domain antibodies, i.e. that do not block ligand binding to PD-1.

| Name | CDR1 sequence of VH | CDR2 sequence of VH | CDR3 sequence of VH | Full length VH sequence with formula 1: FR1-CDR1-FR2-CDR2-FR3-CDR3-FR4 |
|---|---|---|---|---|
| 1.100 a | SEQ ID NO: 447 DYAMS | SEQ ID NO: 448 GITWKG GSTGYA DSVKD | SEQ ID NO: 449 DKYSYAW SYDGFDI | SEQ ID NO: 450 EVQLVESGGGVVRPGGSLRLSCAASG FTFDDYAMSWVRQAPGKGLEWVSGIT WKGGSTGYADSVKDRFTISRDNAKNS LYLQMNSLRAEDTALYYCVRDKYSYA WSYDGFDIWGQGTMVTVSS |
| 1.101 a | SEQ ID NO: 451 DYAMS | SEQ ID NO: 452 GITWRG GSTGYA DSVKD | SEQ ID NO: 453 DKYSYAW SYDGFDI | SEQ ID NO: 454 EVQLVESGGGVVRPGGSLRLSCAASG FTFDDYAMSWVRQAPGKGLEWVSGIT WRGGSTGYADSVKDRFTISRDNAKNS LYLQMNSLRAEDTALYYCVRDKYSYA WSYDGFDIWGQGTMVTVSS |
| 1.102 a | SEQ ID NO: 455 DYAMS | SEQ ID NO: 456 GITWNG GSTGYA DSVKD | SEQ ID NO: 457 DKYSYAW SYDVFDI | SEQ ID NO: 458 EVQLVESGGGVVRPGGSLRLSCAASG FTFDDYAMSWVRQAPGKGLEWVSGIT WNGGSTGYADSVKDRFTISRDNAKNS LYLQMNSLRAEDTALYYCVRDKYSYA WSYDVFDIWGQGTMVTVSS |
| 1.103 a | SEQ ID NO: 459 DYAMS | SEQ ID NO: 460 GITWNG GSTGYA DSVKD | SEQ ID NO: 461 DKYSYAW SYDDFDI | SEQ ID NO: 462 EVQLVESGGGVVRPGGSLRLSCAASG FTFDDYAMSWVRQAPGKGLEWVSGIT WNGGSTGYADSVKDRFTISRDNAKNS LYLQMNSLRAEDTALYYCVRDKYSYA WSYDDFDIWGQGTMVTVSS |

In one embodiment, the second single $V_H$ domain antibody that binds to human PD-1 and blocks ligand binding comprises a CDR3 sequence as shown Table 2 below or a sequence with at least 60%, 70%, 80%, 90%, 95% or more sequence identity thereto. In one embodiment, said sequence homology is at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. In one embodiment, said sequence homology is at least 90%, 91%, 92%, 93%, 94%, 95%, 96%, 97%, 98% or 99%.

In one embodiment, the second $V_H$ single domain antibody has a CDR3 sequence comprising SEQ ID No. 518 or a sequence having at least 60%, 70%, at least 80%, at least 90%, or at least 95% homology to SEQ ID No. 518. In one embodiment, the $V_H$ single domain antibody has a CDR3 sequence comprising SEQ ID No. 955 or a sequence having at least 70%, at least 80%, at least 90%, or at least 95% homology to SEQ ID No. 955. In one embodiment, said sequence homology to SEQ ID No. 518 or 955 is at least 90%, 91%, 92%, 93%, 94%, 95%, 96%, 97%, 98% or 99%.

In one embodiment, the second $V_H$ single domain antibody has a CDR1 as shown in SEQ ID No. 516 or SEQ ID No. 516 with 1 or 2 amino acid substitutions, a CDR2 as shown in SEQ ID No.517 or SEQ ID No. 517 with 1 to 5 amino acid substitutions and a CDR3 as shown in SEQ ID No. 518 or SEQ ID No. 518 with 1 to 5 amino acid substitutions. In one embodiment, the $V_H$ single domain antibody has a CDR1 as shown in SEQ ID No. 740 or SEQ ID No. 740 with 1 or 2 amino acid substitutions, a CDR2 as shown in SEQ ID No. 741 or SEQ ID No. 741 with 1 to 5 amino acid substitutions and a CDR3 as shown in SEQ ID No. 742 or SEQ ID No. 742 with 1 to 5 amino acid substitutions.

In one embodiment, the first $V_H$ single domain antibody comprises a combination of CDR1, 2 and 3 sequences selected from the CDR1, 2 and 3 sequences of a $V_H$ single domain antibody in Table 2 or combinations thereof. In one embodiment, the $V_H$ single domain antibody comprises a set of CDR1, 2 and 3 sequences selected from the sets of CDR1, 2 and 3 sequences as shown for the any of the full length $V_H$ in Table 2. Thus, in one aspect, the first single domain antibody comprises a CDR1, CDR2 and CDR3 selected from CDRs1-3 of full length sequences SEQ ID No: 519, 523, 527, 531, 535, 539, 543, 547, 551, 555, 559, 563, 567, 571, 575, 579, 583, 587, 591, 595, 599, 603, 607, 611, 615, 619, 623, 627, 631, 635, 639, 643, 647, 651, 655, 659, 663, 667, 671, 675, 679, 683, 687, 691, 695, 699, 703, 707, 711, 715, 719, 723, 727, 731, 735, 739, 743, 747, 751, 755, 759, 763, 767, 771, 775, 779, 783, 787, 791, 795, 799, 803, 807, 884, 888, 892, 896, 900, 904, 908, 912, 916, 920, 924, 928, 932, 936, 940, 944, 948, 952, 956, 960, 964, 968, 972, 976, 980, 984, 988, 992, 996, 1000, 1004, 1008, 1012, 1016, 1020, 1024, 1028, 1032, 1036, 1040, 1044 or 1048.

Accordingly, in one embodiment, the second $V_H$ single domain antibody comprises CDR1 having SEQ ID No. 516, CDR2 having SEQ ID No. 517 and CDR3 having SEQ ID No. 518 (CDRs of SEQ ID NO. 519, i.e. clone 1.1b as shown in table b) and so forth. Thus, the second $V_H$ single domain antibody comprises one of the following CDR combinations: SEQ ID Nos. 516, 517, 518; SEQ ID Nos. 520, 521, 522; SEQ ID Nos. 524, 525, 526; SEQ ID Nos. 528, 529, 530; SEQ ID Nos. 532, 533, 534; SEQ ID Nos. 536, 537, 538; SEQ ID Nos. 540, 541, 542; SEQ ID Nos. 544, 545, 546; SEQ ID Nos.548, 549, 550; SEQ ID Nos. 552, 553, 554; SEQ ID Nos. 556, 557, 558; SEQ ID Nos. 560, 561, 562; SEQ ID Nos. 564, 565, 566; SEQ ID Nos. 568, 569, 570; SEQ ID Nos. 572, 573, 574; SEQ ID Nos. 576, 577, 578; SEQ ID Nos.580, 581, 582; SEQ ID Nos. 584, 584, 586; SEQ ID Nos. 588, 589, 590; SEQ ID Nos. 592, 593, 594; SEQ ID Nos. 596, 597, 598; SEQ ID Nos. 600, 601, 602; SEQ ID Nos. 604, 605, 606 SEQ ID Nos. 608, 609, 610; SEQ ID Nos. 612, 613, 614; SEQ ID Nos. 616, 617, 618; SEQ ID Nos. 620, 621, 622; SEQ ID Nos. 624, 625, 626; SEQ ID Nos. 628, 629, 630; SEQ ID Nos. 632, 633, 634; SEQ ID Nos. 636, 637, 638; SEQ ID Nos. 640, 641, 642; SEQ ID Nos. 644, 645, 646; SEQ ID Nos. 648, 649, 650; SEQ ID Nos. 652, 653, 654; SEQ ID Nos. 656, 657, 658; SEQ ID Nos. 660, 661, 662; SEQ ID Nos. 664, 665, 666; SEQ ID Nos. 668, 669, 670; SEQ ID Nos. 672, 673, 674; SEQ ID Nos. 676, 677, 678; SEQ ID Nos. 680, 681, 682; SEQ ID Nos. 684, 685, 686; SEQ ID Nos. 688, 689, 690; SEQ ID Nos. 692, 694, 694; SEQ ID Nos. 696, 697, 698; SEQ ID Nos. 700, 701, 702; SEQ ID Nos. 704, 705, 706; SEQ ID Nos. 708, 709, 710; SEQ ID Nos. 712, 713, 714; SEQ ID Nos. 716, 717, 718; SEQ ID Nos. 720, 721, 722; SEQ ID Nos. 724, 725, 726; SEQ ID Nos. 728, 729, 730; SEQ ID Nos. 732, 733, 734; SEQ ID Nos. 736, 737, 738; SEQ ID Nos. 740, 741, 742; SEQ ID Nos. 744, 745, 746; SEQ ID Nos. 748, 749, 750; SEQ ID Nos. 752, 753, 754; SEQ ID Nos. 756, 757, 758; SEQ ID Nos. 760, 761, 762; SEQ ID Nos. 764, 765, 766; SEQ ID Nos. 768, 769, 770; SEQ ID Nos. 772, 773, 774; SEQ ID Nos. 776, 777, 778; SEQ ID Nos. 780, 781, 782; SEQ ID Nos. 784, 785, 786; SEQ ID Nos. 788, 789, 790; SEQ ID Nos. 792, 793, 794; SEQ ID Nos. 796, 797, 798; SEQ ID Nos. 800, 801, 802; SEQ ID Nos. 804, 805, 806; SEQ ID Nos. 881, 882, 883; SEQ ID Nos. 885, 886, 887; SEQ ID Nos. 889, 890, 891; SEQ ID Nos. 893, 894, 895; SEQ ID Nos. 897, 898, 899; SEQ ID Nos. 901, 902, 903; SEQ ID Nos. 905, 906, 907; SEQ ID Nos. 909, 910, 911; SEQ ID Nos. 913, 914, 915; SEQ ID Nos. 917, 918, 919; SEQ ID Nos. 921, 922, 923; SEQ ID Nos. 925, 926, 927; SEQ ID Nos. 929, 930, 931; SEQ ID Nos. 933, 934, 935; SEQ ID Nos. 937, 938, 939; SEQ ID Nos. 941, 942, 943; SEQ ID Nos. 945, 946, 947; SEQ ID Nos. 949, 950, 951; SEQ ID Nos. 953, 954, 955; SEQ ID Nos. 957, 958, 959; SEQ ID Nos. 961, 962, 963; SEQ ID Nos. 965, 966, 967; SEQ ID Nos. 969, 970, 971; SEQ ID Nos. 973, 974, 975; SEQ ID Nos. 977, 978, 979; SEQ ID Nos. 981, 982, 983; SEQ ID Nos. 985, 986, 987; SEQ ID Nos. 989, 990, 991; SEQ ID Nos. 993, 994, 995; SEQ ID Nos. 997, 998, 999; SEQ ID Nos. 1001, 1002, 1003; SEQ ID Nos. 1005, 1006, 1007; SEQ ID Nos. 1009, 1100, 1011; SEQ ID Nos. 1013, 1014, 1015; SEQ ID Nos. 1017, 1018, 1019; SEQ ID Nos. 1021, 1022, 1023; SEQ ID Nos. 1025, 1026, 027; SEQ ID Nos. 1029, 1030; 1031; SEQ ID Nos. 1033, 1034, 1035; SEQ ID Nos. 1037, 1038, 1039; SEQ ID Nos. 1041, 1042, 1043 or SEQ ID Nos. 1045, 1046, 1047, In another embodiment, the second $V_H$ single domain antibody comprises or consists of a polypeptide sequence as shown for any one of $V_H$ single domain antibodies 1.1b to 1.115 bas shown in Table 2 or a sequence with at least 60%, 70%, 80%, 90%, 95% or more sequence homology thereto. Thus, the $V_H$ single domain antibody comprises or consists of an amino acid sequence selected from SEQ ID Nos. 519, 523, 527, 531, 535, 539, 543, 547, 551, 555, 559, 563, 567, 571, 575, 579, 583, 587, 591, 595, 599, 603, 607, 611, 615, 619, 623, 627, 631, 635, 639, 643, 647, 651, 655, 659, 663, 667, 671, 675, 679, 683, 687, 691, 695, 699, 703, 707, 711, 715, 719, 723, 727, 731, 735, 739, 743, 747, 751, 755, 759, 763, 767, 771, 775, 779, 783, 787, 791, 795, 799, 803, 807, 884, 888, 892, 896, 900, 904, 908, 912, 916, 920, 924, 928, 932, 936, 940, 944, 948, 952, 956, 960, 964, 968, 972, 976, 980, 984, 988, 992, 996, 1000, 1004, 1008, 1012, 1016, 1020, 1024, 1028, 1032, 1036, 1040, 1044 or 1048 or a sequence with at least 60%, 70%, 80%, 90%, 95% or more sequence homology thereto. In another embodiment, the second $V_H$ single domain antibody comprises or consists of a polypeptide sequence as shown for any one of $V_H$ single domain antibodies 1.73b to 1.115b as shown in Table 2 or a sequence with at least 60%, 70%, 80%, 90%, 95% or more sequence homology thereto.

In one embodiment, the $V_H$ single domain antibody comprises or consists of SEQ ID No. 4519, 743, 896 or 956 a sequence with at least 60%, 70%, 80%, 90%, 95% or more sequence homology thereto.

In one embodiment, said sequence homology as above is at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%.

TABLE 2

Full length sequences and CDR sequences of the second VH single domain; i.e. VH single domain that blocks ligand binding to PD-1.

| Clone name | CDR1 | CDR2 | CDR3 | Full length VH |
|---|---|---|---|---|
| 1.1b | DYTMT SEQ NO. 516 | YISTGGTI KYYTDSV KG SEQ NO. 517 | EAPLRLG ESPHDAF DI SEQ NO. 518 | SEQ NO. 519 QVQLVESGGGLVKPGGSLRLSCAASGFTF SDYTMTWMRQAPGKGLEWVSYISTGGTIK YYTDSVKGRFTISRDNAKNSLYLQMNSLRA DDTAVYYCAREAPLRLGESPHDAFDIWGQ GTMVTVSS |
| 1.2b | DYTMT SEQ NO. 520 | YISTGGSI KYYTDSV KG SEQ NO. 521 | EAPLRLG ESPHDAF DI SEQ NO. 522 | SEQ NO. 523 EVQLLESGGGLVKPGGSLRLSCAASGFTF SDYTMTWMRQAPGKGLEWVSYISTGGSIK YYTDSVKGRFTISRDNAKNSLYLQMNSLRA DDTAVYYCAREAPLRLGESPHDAFDIWGQ GTMVTVSS |
| 1.3b | DYTMT SEQ NO. 524 | YISTGGSI KYYTDSV KG SEQ NO. 525 | EAPLRLG ESPHDAF DI SEQ NO. 526 | SEQ NO. 527 QVQLVESGGGLVKPGGSLRLSCAASGFTF SDYTMTWMRQAPGKGLEWVSYISTGGSIK YYTDSVKGRFTISRDNAKNSLYLQMNSLRA DDTAVYYCAREAPLRLGESPHDAFDIWGQ GTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.4b | DYYMI SEQ NO. 528 | YISGGGT TKYYTDS VKG SEQ NO. 529 | EAPLRLG ETPHDAF DI SEQ NO. 530 | SEQ NO. 531 QVQLVESGGGLVKPGGSLRLSCAASGFTF SDYYMIWMRQAPGKGLEWVSYISGGGTTK YYTDSVKGRFTISRDNAKNSLYLQMNSLRA DDTAVYYCAREAPLRLGETPHDAFDIWGQ GTMVTVSS |
| 1.5b | DYTMT SEQ NO. 532 | YISTGGNT KYYTDSV KG SEQ NO. 533 | EAPLRLG ESPHDAF DI SEQ NO. 534 | SEQ NO. 535 EVQLVESGGGLVKPGGSLRLSCAASGFTF SDYTMTWMRQAPGKGLEWVSYISTGGNT KYYTDSVKGRFTISRDNAKNSLYLQMNSLR ADDTAVYYCAREAPLRLGESPHDAFDIWG QGTMVTVSS |
| 1.6b | DYTMT SEQ NO. 536 | YISTGGTI KYYTDSV KG SEQ NO. 537 | EAPLRLG ESPHDAF DI SEQ NO. 538 | SEQ NO. 539 EVQLLESGGGLVKPGGSLRLSCAASGFTF SDYTMTWMRQAPGKGLEWVSYISTGGTI YYTDSVKGRFTISRDNAKNSLYLQMSSLRA DDTAVYYCAREAPLRLGESPHDAFDIWGQ GTMVTVSS |
| 1.7b | DYTMT SEQ NO. 540 | YISTGGTI KYYTDSV KG SEQ NO. 541 | EAPLRLG ESPHDAF DI SEQ NO. 542 | SEQ NO. 543 EVQLVESGGGLVKPGGSLRLSCAASGFTF SDYTMTWMRQAPGKGLEWVSYISTGGTIK YYTDSVKGRFTISRDNAKNSLYLQMNSLRA DDTAVYYCAREAPLRLGESPHDAFDIWGQ GTMVTVSS |
| 1.8b | DYTMT SEQ NO. 544 | YISTGGSI KYYTDSV KG SEQ NO. 545 | EAPLRLG ESPHDAF DI SEQ NO. 546 | SEQ NO. 547 EVQLVESGGGLVKPGGSLRLSCAASGFTF SDYTMTWMRQAPGKGLEWVSYISTGGSIK YYTDSVKGRFTISRDNAKNSLYLQMNSLRA GDTAVYYCAREAPLRLGESPHDAFDIWGQ GTMVTVSS |
| 1.9b | DYTMT SEQ NO. 548 | YISTGGTI KYYTDSV KG SEQ NO. 549 | EAPLRLG ESPHDAF DI SEQ NO. 550 | SEQ NO. 551 QVQLVESGGGLVKPGGSLRLSCAASGFTF SDYTMTWMRQAPGKGLEWVSYISTGGTI GDYTMTWMRQAPGKGLEWVSYISTGGTIK YYTDSVKGRFTISRDNAKNSLYLQMDSLRA DDTAVYYCAREAPLRLGESPHDAFDIWGQ GTMVTVSS |
| 1.10b | DYTMS SEQ NO. 552 | YISLGGNT KYYTDSV KG SEQ NO. 553 | EAPLRLG ESPHDAF DI SEQ NO. 554 | SEQ NO. 555 QVQLVESGGGLVKPGGSLRLSCAASGFTF SDYTMSWMRQAPGKGLEWISYISLGGNTK YYTDSVKGRFTISRDNAKNSLYLQMNSLRA DDTAVYYCAREAPLRLGESPHDAFDIWGQ GTMVTVSS |
| 1.11b | DYDMT SEQ NO. 556 | YISRGGS TKYYADS VKG SEQ NO. 557 | EAPLRLG ETPHDAF DI SEQ NO. 558 | SEQ NO. 559 EVQLLESGGGLVKPGGSLRLSCAASGFTF SDYDMTWIRQAPGKGQEWVSYISRGGST KYYADSVKGRFTISRDNAKNSLYLQMNSLR AEDTAVYYCAREAPLRLGETPHDAFDIWG QGTMVTVSS |
| 1.12b | DYYM G SEQ NO. 560 | YISSSGST IYYADSVK G SEQ NO. 561 | EAPLRLG ESPHDAF DI SEQ NO. 562 | SEQ NO. 563 EVQLLESGGGVVKPGGSLRLSCAASGFTF SDYYMGWIRQAPGKGLEWISYISSSGSTIY YADSVKGRFTISRDNAKNSLYLQMNSLRAE DTAVYYCAREAPLRLGESPHDAFDIWGQG TMVTVSS |
| 1.13b | DYTMT SEQ NO. 564 | YISTGGTI KYYTDSV KG SEQ NO. 565 | EAPLRLG ESPHDAF DI SEQ NO. 566 | SEQ NO. 567 EVQLLESGGGLVKPGGSLRLSCAASGFTF SDYTMTWMRQAPGKGLEWVSYISTGGTIK YYTDSVKGRFTISRDNAKNSLYLQMNSLRA DDTAVYYCAREAPLRLGESPHDAFDIWGQ GTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.14b | DYTMT SEQ NO. 568 | YISTGGTI KYYTDSV KG SEQ NO. 569 | EAPLRLG ESPHDAF DI SEQ NO. 570 | SEQ NO. 571 EVQLVESGGGLVQPGRSLRLSCAASGFTF SDYTMTWMRQAPGKGLEWVSYISTGGTIK YYTDSVKGRFTISRDNAKNSLYLQMNSLRA DDTAVYYCAREAPLRLGESPHDAFDIWGQ GTMVTVSS |
| 1.15b | DNSMS SEQ NO. 572 | YISSSGST IYYADSVK G SEQ NO. 573 | EAPLRLG ESPHDAF DI SEQ NO. 574 | SEQ NO. 575 QVQLVESGGGLVKPGGSLRLSCAASGFTF SDNSMSWIRQAPGKGLEWVSYISSSGSTIY YADSVKGRFTISRDNAKNSLYLQMNTLRAE DTAVYYCAKEAPLRLGESPHDAFDIWGQG TMVTVSS |
| 1.16b | DYTMS SEQ NO. 576 | YISTGGSI KYYTDSV KG SEQ NO. 577 | EAPLRLG ESPHDAF DI SEQ NO. 578 | SEQ NO. 579 EVQLVESGGGLVKPGGSLRLSCAASGFTF SDYTMSWMRQAPGKGLEWVSYISTGGSIK YYTDSVKGRFTISRDNAKNSLYLQMNSLRA DDTAVYYCAREAPLRLGESPHDAFDIWGQ GTMVTVSS |
| 1.17b | DYTMT SEQ NO. 580 | YISTGGSI KYYTDSV KG SEQ NO. 581 | EAPLRLG ESPHDAF DI SEQ NO. 582 | SEQ NO. 583 EVQLVESGGGLVKPGGSLRLSCAASGFTF SDYTMTWMRQAPGKGLEWVSYISTGGSIK YYTDSVKGRFTISRDNAKNSLYLQMNSLRV DDTAVYYCAREAPLRLGESPHDAFDIWGQ GTMVTVSS |
| 1.18b | DYTMT SEQ NO. 584 | YISTGGTI KYYTDSV KG SEQ NO. 585 | EAPLRLG ESPHDAF DI SEQ NO. 586 | SEQ NO. 587 QVQLLESGGGLVKPGGSLRLSCAASGFTF SDYTMTWMRQAPGKGLEWVSYISTGGTIK YYTDSVKGRFTISRDNAKNSLYLQMNSLRA DDTAVYYCAREAPLRLGESPHDAFDIWGQ GTMVTVSS |
| 1.19b | DYTMT SEQ NO. 588 | YISTGGSI KYYTDSV KG SEQ NO. 589 | ETPHDAF DI SEQ NO. 590 | SEQ NO. 591 QVQLVESGGGLVKPGGSLRLSCAASGFTF SDYTMTWMRQAPGKGLEWVSYISTGGSIK YYTDSVKGRFTISRDNAKNSLYLQMNSLRA EDTAVYYCAREAPLRLGETPHDAFDIWGQ GTMVTVSS |
| 1.20b | DYTMT SEQ NO. 592 | YISSGGSI KFYADSV KG SEQ NO. 593 | EAPLRLG ESPHDAF DI SEQ NO. 594 | SEQ NO. 595 EVQLLESGGGLVKPGGSLRLSCAASGFTF SDYTMTWMRQAPGKGLEWVSYISSGGSIK FYADSVKGRFTISRDNAKNSLYLQMNSLRA EDTAVYYCAREAPLRLGESPHDAFDIWGQ GTMVTVSS |
| 1.21b | DYTMT SEQ NO. 596 | YISTGGSI KYYTDSV KG SEQ NO. 597 | EAPLRLG ESPHDAF DT SEQ NO. 598 | SEQ NO. 599 EVQLVESGGGLVKPGGSLRLSCAASGFTF SDYTMTWMRQAPGKGLEWVSYISTGGSIK YYTDSVKGRFTISRDNAKNSLYLQMNSLRA DDTAVYYCAREAPLRLGESPHDAFDTWGQ GTMVTVSS |
| 1.22b | DYTMT SEQ NO. 600 | YISTGGSI KYYTDSV KG SEQ NO. 601 | EAPLRLG ESPHDAF DI SEQ NO. 602 | SEQ NO. 603 EVQLVESGGGLVKPGGSLRLSCAASGFTF SDYTMTWMRQAPGKGLEWVSYISTGGSIK YYTDSVKGRFTISRDNAKNSLYLQMNSLRA DDTAVYYCAREAPLRLGESPHDAFDIWGQ GTMVTVSS |
| 1.23b | DYTMS SEQ NO. 604 | YISTGGTI KYYTDSV KG SEQ NO. 605 | EAPLRLG ESPHDAF DI SEQ NO. 606 | SEQ NO. 607 QITLKESGGGLVKPGGSLRLSCAASGFTFS DYTMSWMRQAPGKGLEWVSYISTGGTIKY YTDSVKGRFTISRDNAKNSLYLQMNSLRAD DTAVYYCAREAPLRLGESPHDAFDIWGQG TMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.24b | DYDMY SEQ NO. 608 | YISRGGS VTYYADS VKG SEQ NO. 609 | EAPLRLG ETPHAAF DI SEQ NO. 610 | SEQ NO. 611 QVTLKESGGGLVKPGGSLRLSCAASGFTF SDYDMYWIRQAPGKGLEWVSYISRGGSVT YYADSVKGRFTISRDNAKNALYLQMNSLRA EDMAVYFCATEAPLRLGETPHAAFDIWGQ GTMVTVSS |
| 1.25b | DYYMS SEQ NO. 612 | FISSSGST TYYADSV KG SEQ NO. 613 | EAPLRLG ESPHDAF DF SEQ NO. 614 | SEQ NO. 615 QVTLKESGGGLVKPGGSLRLSCAASGFTF SDYYMSWFRQAPGKEREWISFISSSGSTT YYADSVKGRFTISRDNAKNSLYLQMNSLRA EDTAVYYCAREAPLRLGESPHDAFDFWGQ GTMVTVSS |
| 1.26b | DNSMS SEQ NO. 616 | YISSSGST IYYADSVK G SEQ NO. 617 | EAPLRLG ESPHDAF DI SEQ NO. 618 | SEQ NO. 619 QVTLKESGGGLVKPGGSLRLSCAASGFTF SDNSMSWIRQAPGKGLEWVSYISSSGSTIY YADSVKGRFTISRDNAKNSLYLQMNTLRAE DTAVYYCAKEAPLRLGESPHDAFDIWGQG TMVTVSS |
| 1.27b | DYTMT SEQ NO. 620 | YISTGGSI KYYTDSV KG SEQ NO. 621 | EAPLRLG ESPHDAF DI SEQ NO. 622 | SEQ NO. 623 QVTLKESGGGLVKPGGSLRLSCAASGFTF SDYTMTWMRQAPGKGLEWVSYISTGGSIK YYTDSVKGRFTISRDNAKNSLYLQMNSLRA DDTAVYYCAREAPLRLGESPHDAFDIWGQ GTMVTVSS |
| 1.28b | DYDMY SEQ NO. 624 | YISRGGS VTYYADS VKG SEQ NO. 625 | EAPLRLG ETPHAAF DI SEQ NO. 626 | SEQ NO. 627 QITLKESGGGLVKPGGSLRLSCAASGFTFS DYDMYWIRQAPGKGLEWVSYISRGGSVTY YADSVKGRFTISRDNAKNALYLQMNSLRAE DMAVYFCATEAPLRLGETPHAAFDIWGQG TMVTVSS |
| 1.29b | DYTMS SEQ NO. 628 | YISTGGTI KYYTDSV KG SEQ NO. 629 | EAPLRLG ESPHDAF DI SEQ NO. 630 | SEQ NO. 631 QVTLKESGGGLVKPGGSLRLSCAASGFTF SDYTMSWMRQAPGKGLEWVSYISTGGTIK YYTDSVKGRFTISRDNAKNSLYLQMNSLRA DDTAVYYCAREAPLRLGESPHDAFDIWGQ GTMVTVSS |
| 1.30b | DYTMT SEQ NO. 632 | YISTGGSI KYYTDSV KG SEQ NO. 633 | EAPLRLG ESPHDAF DI SEQ NO. 634 | SEQ NO. 635 QVTLKESGGGLVKPGGSLRLSCAASGFTF SDYTMTWMRQAPGKGLEWVSYISTGGSIK YYTDSVKGRFTISRDNARNSLYLQMNSLRA EDTAVYYCAREAPLRLGESPHDAFDIWGQ GTMVTVSS |
| 1.31b | DYTMT SEQ NO. 636 | YISTGGST KYYTDSV KG SEQ NO. 637 | EAPLRLG ESPHDAF DI SEQ NO. 638 | SEQ NO. 639 QVTLKESGGGLVKPGGSLRLSCAASGFTF SDYTMTWMRQAPGKGLEWVSYISTGGST KYYTDSVKGRFTISRDNAKNSLYLQMNSLR ADDTAVYYCAREAPLRLGESPHDAFDIWG QGTMVTVSS |
| 1.32b | DDYMM SEQ NO. 640 | YISSGGSII YYADSVK G SEQ NO. 641 | EAPLRLG ESPHDAF DI SEQ NO. 642 | SEQ NO. 643 QVTLKESGGGLVKPGGSLRLSCAASGFTF SDDYMMWIRQAPGKGLEWVSYISSGGSIIY YADSVKGRFTISRDNAKNSLYLQMNSLRAE DTAVYYCAREAPLRLGESPHDAFDIRGQG TMVTVSS |
| 1.33b | DYDMY SEQ NO. 644 | YISRGGS VTYYADS VKG SEQ NO. 645 | EAPLRLG ETPHAAF DI SEQ NO. 646 | SEQ NO. 647 QITLKESGGGLVKPGGSLRLSCAASGFTFS DYDMYWVRQAPGKGLEWVSYISRGGSVT YYADSVKGRFTISRDNAKNALYLQMNSLRA EDMAVYFCATEAPLRLGETPHAAFDIWGQ GTMVTVSS |

TABLE 2-continued

Full length sequences and CDR sequences of the second VH single domain; i.e. VH single domain that blocks ligand binding to PD-1.

| Clone name | CDR1 | CDR2 | CDR3 | Full length VH |
|---|---|---|---|---|
| 1.34b | DYTMT SEQ NO. 648 | YISTGGSV KYYTDSV KG SEQ NO. 649 | EAPLRLG ESPHDAF DI SEQ NO. 650 | SEQ NO. 651 EVQLVESGGGLVKPGGSLRLSCAASGFTF SDYTMTWMRQAPGKGLEWVSYISTGGSV KYYTDSVKGRFTISRDNAKNSLYLQMNSLR ADDTAVYYCAREAPLRLGESPHDAFDIWG QGTMVTVSS |
| 1.35b | DYTMT SEQ NO. 652 | YISTGGSI KYYTDSV KG SEQ NO. 653 | EAPLRLG ESPHDAF DI SEQ NO. 654 | SEQ NO. 655 EVQLLESGGGLVKPGGSLRLSCAASGFTF SDYTMTWMRQAPGKGLEWVSYISTGGSI KYYTDSVKGRFTISRDNAKNSLYLQMNSLRV DDTAVYYCAREAPLRLGESPHDAFDIWGQ GTMVTVSS |
| 1.36b | DYTMT SEQ NO. 656 | YISTGGTI KYYTDSV KG SEQ NO. 657 | EAPLRLG ESPHDAF DI SEQ NO. 658 | SEQ NO. 659 EVQLVESGGGLVKPGGSLRLSCAASGFTF SDYTMTWMRQAPGKGLEWVSYISTGGTIK YYTDSVKGRFTISRDNAKNSLFLQMNSLRA DDTAVYYCAREAPLRLGESPHDAFDIWGQ GTMVTVSS |
| 1.37b | DYTMT SEQ NO. 660 | YISTGGSI KYYTDSV KG SEQ NO. 661 | EAPLRLG ESPHDAF DI SEQ NO. 662 | SEQ NO. 663 QVQLVESGGGLVKPGGSLRLSCAASGFTF SDYTMTWMRQAPGKGLEWVSYISTGGSIK YYTDSVKGRFTISRDNAKNSLFLQMNSLRA DDTAVYYCAREAPLRLGESPHDAFDIWGQ GTMVTVSS |
| 1.38b | DYTMT SEQ NO. 664 | YISTGGTI KYYTDSV KG SEQ NO. 665 | EAPLRLG ESPHDAF DI SEQ NO. 666 | SEQ NO. 667 EVQLVESGGGLVQPGGSLRLSCAASGFTF SDYTMTWMRQAPGKGLEWVSYISTGGTIK YYTDSVKGRFTISRDNAKNSLYLQMNSLRA DDTAVYYCAREAPLRLGESPHDAFDIWGQ GTMVTVSS |
| 1.39b | DYTMT SEQ NO. 668 | YISTGGSI KYYTDSV KG SEQ NO. 669 | EAPLRLG ESPHDAF DI SEQ NO. 670 | SEQ NO. 671 QVQLQESGGGLVKPGGSLRLSCAASGFTF SDYTMTWMRQAPGKGLEWVSYISTGGSIK YYTDSVKGRFTISRDNAKNSLYLQMNSLRA DDTAVYYCAREAPLRLGESPHDAFDIWGQ GTMVTVSS |
| 1.40b | DSSMS SEQ NO. 672 | YISSGGGI IYYTDSVK G SEQ NO. 673 | EAPLRLG ESPHDAF DI SEQ NO. 674 | SEQ NO. 675 EVQLVESGGGLVKPGGSLRLSCAASGFTF SDSSMSWIRQAPGRGLEWISYISSGGGIIY YTDSVKGRFTISRDNAKNSLYLQMNSLRVE DTAVYYCAKEAPLRLGESPHDAFDIWGHG TMVTVSS |
| 1.41b | DNSMT SEQ NO. 676 | YISSGGG VIFYADSV KG SEQ NO. 677 | EAPLRLG ESPHDAF DI SEQ NO. 678 | SEQ NO. 679 QVQLVESGGGLVKPGGSLRLSCAASGFTF SDNSMTWMRQAPGKGLEWVSYISSGGGV IFYADSVKGRFTISRDNAKNSLYLQMNSLR ADDTAVYYCAREAPLRLGESPHDAFDIWG QGTMVTVSS |
| 1.42b | DNSMT SEQ NO. 680 | YISSGGG VKFYADS VKG SEQ NO. 681 | EAPLRLG ESPHDAF DI SEQ NO. 682 | SEQ NO. 683 QVQLVESGGGLVKPGGSLRLSCAASGFTF SDNSMTWMRQAPGKGLEWVSYISSGGGV KFYADSVKGRFTISRDNAKNSLYLQMNSLR ADDTAVYYCAREAPLRLGESPHDAFDIWG QGTMVTVSS |
| 1.43b | DSSMT SEQ NO. 684 | YISSGGG VIFYADSV KG SEQ NO. 685 | EAPLRLG ESPHDAF DI SEQ NO. 686 | SEQ NO. 687 QVQLVESGGGLVKPGGSLRLSCAASGFTF SDSSMTWMRQAPGKGLEWVSYISSGGGV IFYADSVKGRFTISRDNAKNSLYLQMNSLR ADDTAVYYCAREAPLRLGESPHDAFDIWG QGTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.44b | DNSMT SEQ NO. 688 | YISSGGA VKFYADS VKG SEQ NO. 689 | EAPLRLG ESPHDAF DI SEQ NO. 690 | SEQ NO. 691 QVQLVESGGGLVKPGGSLRLSCAASGFTF SDNSMTWMRQAPGKGLEWVSYISSGGAV KFYADSVKGRFTISRDNAKNSLYLQMNSLR ADDTAVYYCAREAPLRLGESPHDAFDIWG QGTMVTVSS |
| 1.45b | DYSMS SEQ NO. 692 | YISSGGG VIFYADSV KG SEQ NO. 693 | EAPLRLG ESPHDAF DI SEQ NO. 694 | SEQ NO. 695 QVQLVESGGGLVKPGGSLRLSCAASGFTF SDYSMSWMRQAPGKGLEWVSYISSGGGV IFYADSVKGRFTISRDNAKNSLYLQMNSLR ADDTAVYYCAREAPLRLGESPHDAFDIWG QGTMVTVSS |
| 1.46b | DSSMS SEQ NO. 696 | YISSGGG VIFYADSV KG SEQ NO. 697 | EAPLRLG ESPHDAF DI SEQ NO. 698 | SEQ NO. 699 QVQLVESGGGLVKPGGSLRLSCAASGFTF SDSSMSWMRQAPGKGLEWVSYISSGGGV IFYADSVKGRFTISRDNAKNSLYLQMNSLR ADDTAVYYCAREAPLRLGESPHDAFDIWG QGTMVTVSS |
| 1.47b | DNSM S SEQ NO. 700 | YISSGGG VIFYADSV KG SEQ NO. 701 | EAPLRLG ESPHDAF DI SEQ NO. 702 | SEQ NO. 703 QVQLVESGGGLVKPGGSLRLSCAASGFTF SDNSMSWMRQAPGKGLEWVSYISSGGGV IFYADSVKGRFTISRDNAKNSLYLQMNSLR ADDTAVYYCAREAPLRLGESPHDAFDIWG QGTMVTVSS |
| 1.48b | DSSMT SEQ NO. 704 | YISSGGG VKFYADS VKG SEQ NO. 705 | EAPLRLG ESPHDAF DI SEQ NO. 706 | SEQ NO. 707 QVQLVESGGGLVKPGGSLRLSCAASGFTF SDSSMTWMRQAPGKGLEWVSYISSGGGV KFYADSVKGRFTISRDNAKNSLYLQMNSLR ADDTAVYYCAREAPLRLGESPHDAFDIWG QGTMVTVSS |
| 1.49b | DSSMS SEQ NO. 708 | YISTGGG VKFYADS VKG SEQ NO. 709 | EAPLRLG ESPHDAF DI SEQ NO. 710 | SEQ NO. 711 QVQLVESGGGLVKPGGSLRLSCAASGFTF SDSSMSWMRQAPGKGLEWVSYISTGGGV KFYADSVKGRFTISRDNAKNSLYLQMNSLR ADDTAVYYCAREAPLRLGESPHDAFDIWG QGTMVTVSS |
| 1.50b | DNSMT SEQ NO. 712 | YISSGGTI KFYADSV KG SEQ NO. 713 | EAPLRLG ESPHDAF DI SEQ NO. 714 | SEQ NO. 715 QVQLVESGGGLVKPGGSLRLSCAASGFTF SDNSMTWMRQAPGKGLEWVSYISSGGTIK FYADSVKGRFTISRDNAKNSLYLQMNSLRA DDTAVYYCAREAPLRLGESPHDAFDIWGQ GTMVTVSS |
| 1.51b | DSSMT SEQ NO. 716 | YISSGGA VKFYTDS VKG SEQ NO. 717 | EAPLRLG ESPHDAF DI SEQ NO. 718 | SEQ NO. 719 QVQLVESGGGLVKPGGSLRLSCAASGFTF SDSSMTWMRQAPGKGLEWVSYISSGGAV KFYTDSVKGRFTISRDNAKNSLYLQMNSLR ADDTAVYYCAREAPLRLGESPHDAFDIWG QGTMVTVSS |
| 1.52b | DNSMT SEQ NO. 720 | YISSGGG VKYYADS VKG SEQ NO. 721 | EAPLRLG ESPHDAF DI SEQ NO. 722 | SEQ NO. 723 QVQLVESGGGLVKPGGSLRLSCAASGFTF SDNSMTWMRQAPGKGLEWVSYISSGGGV KYYADSVKGRFTISRDNAKNSLYLQMNSLR ADDTAVYYCAREAPLRLGESPHDAFDIWG QGTMVTVSS |
| 1.53b | DNSMT SEQ NO. 724 | YISSGGS VKFYADS VKG SEQ NO. 725 | EAPLRLG ESPHDAF DI SEQ NO. 726 | SEQ NO. 727 QVQLVESGGGLVKPGGSLRLSCAASGFTF SDNSMTWMRQAPGKGLEWVSYISSGGSV KFYADSVKGRFTISRDNAKNSLYLQMNSLR ADDTAVYYCAREAPLRLGESPHDAFDIWG QGTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.54b | DDSMT SEQ NO. 728 | YISSGGG VIFYADSV KG SEQ NO. 729 | EAPLRLG ESPHDAF DI SEQ NO. 730 | SEQ NO. 731 QVQLVESGGGLVKPGGSLRLSCAASGFTF SDDSMTWMRQAPGKGLEWVSYISSGGGV IFYADSVKGRFTISRDNAKNSLYLQMNSLR ADDTAVYYCAREAPLRLGESPHDAFDIWG QGTMVTVSS |
| 1.55b | DNSMT SEQ NO. 732 | YISSGGG VKFYADS VKG SEQ NO. 733 | EAPLRLG ESPHDAF DI SEQ NO. 734 | SEQ NO. 735 QVQLVESGGGLVKPGGSLRLSCAASGFTF SDNSMTWMRQAPGKGLEWVSYISSGGGV KFYADSVKGRFTISRDNAKNSLYLQMNSLR ADDTAVYYCAREAPLRLGESPHDAFDI SGQGTMVTVSS |
| 1.56b | DNSMT SEQ NO. 736 | YISSGGA VKFYADS VKG SEQ NO. 737 | EAPLRLG ESPHDAF DI SEQ NO. 738 | SEQ NO. 739 QVQLVESGGGLVKPGGSLRLSCAASGFTF SDNSMTWMRQAPGKGLEWVSYISSGGAV KFYADSVKGRFTISRDNAKNSLYLQMNSLR ADDTAVYYCAREAPLRLGESPHDAFDILGQ GTMVTVSS |
| 1.57b | DNSMT SEQ NO. 740 | YISSGGG VIFYADSV KG SEQ NO. 741 | EAPLRLG ESPHDAF DI SEQ NO. 742 | SEQ NO. 743 QVQLVESGGGLVKPGGSLRLSCAASGFTF SDNSMTWMRQAPGKGLEWVSYISSGGGV IFYADSVKGRFTISRDNAKNSLYLQMNSLR ADDTAVYYCAREAPLRLGESPHDAFDISG QGTMVTVSS |
| 1.58b | DNTMT SEQ NO. 744 | YISTGGG VKFYADS VKG SEQ NO. 745 | EAPLRLG ESPHDAF DI SEQ NO. 746 | SEQ NO. 747 QVQLVESGGGLVKPGGSLRLSCAASGFTF SDYTMTWMRQAPGKGLEWVSYISTGGTIK YYTDSVKGRFTISRDNAKNSLYLQMNSLRA DDTAVYYCAREAPLRLGESPHDAFDIWGQ GTMVTVSS |
| 1.59b | DNSMS SEQ NO. 748 | YISSGGS VKFYADS VKG SEQ NO. 749 | EAPLRLG ESPHDAF DI SEQ NO. 750 | SEQ NO. 751 QVQLVESGGGLVKPGGSLRLSCAASGFTF SDNTMTWMRQAPGKGLEWVSYISTGGGV KFYADSVKGRFTISRDNAKNSLYLQMNSLR ADDTAVYYCAREAPLRLGESPHDAFDIWG QGTMVTVSS |
| 1.60b | DNSMT SEQ NO. 752 | YISTGGG VKYYADS VKG SEQ NO. 753 | EAPLRLG ESPHDAF DI SEQ NO. 754 | SEQ NO. 755 QVQLVESGGGLVKPGGSLRLSCAASGFTF SDNSMSWMRQAPGKGLEWVSYISSGGSV KFYADSVKGRFTISRDNAKNSLYLQMNSLR ADDTAVYYCAREAPLRLGESPHDAFDIWG QGTMVTVSS |
| 1.61b | DYTMS SEQ NO. 756 | YISTGGG VKFYADS VKG SEQ NO. 757 | EAPLRLG ESPHDAF DI SEQ NO. 758 | SEQ NO. 759 QVQLVESGGGLVKPGGSLRLSCAASGFTF SDNSMTWMRQAPGKGLEWVSYISTGGGV KYYADSVKGRFTISRDNAKNSLYLQMNSLR ADDTAVYYCAREAPLRLGESPHDAFDIWG QGTMVTVSS |
| 1.62b | DSSMT SEQ NO. 760 | YISSGGA VKFYTDS VKG SEQ NO. 761 | EAPLRLG ESPHDAF DI SEQ NO. 762 | SEQ NO. 763 QVQLVESGGGLVKPGGSLRLSCAASGFTF SDSSMTWMRQAPGKGLEWVSYISSGGAV KFYTDSVKGRFTISRDNAKNSLYLQMNSLR ADDTAVYYCAREAPLRLGESPHDAFDISG QGTMVTVSS |
| 1.63b | DSSMT SEQ NO. 764 | YISSGGG VKFYTDS VKG SEQ NO. 765 | EAPLRLG ESPHDAF DI SEQ NO. 766 | SEQ NO. 767 EVQLVESGGGLVKPGGSLRLSCAASGFTF SDSSMTWMRQAPGKGLEWVSYISSGGGV KFYTDSVKGRFTISRDNAKNSLYLQMNSLR ADDTAVYYCAREAPLRLGESPHDAFDISG QGTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.64b | DSSMT SEQ NO. 768 | YISSGGG VKFYADS VKG SEQ NO. 769 | EAPLRLG ESPHDAF DI SEQ NO. 770 | SEQ NO. 771 EVQLVESGGGLVKPGGSLRLSCAASGFTF SDSSMTWMRQAPGKGLEWVSYISSGGGV KFYADSVKGRFTISRDNAKNSLYLQMNSLR ADDTAVYYCAREAPLRLGESPHDAFDISG QGTMVTVSS |
| 1.65b | DSSMT SEQ NO. 772 | YISSGGG VKFYADS VKG SEQ NO. 773 | EAPLRLG ESPHDAF DI SEQ NO. 774 | SEQ NO. 775 QVQLVESGGGLVKPGGSLRLSCAASGFTF SDSSMTWMRQAPGKGLEWVSYISSGGGV KFYADSVKGRFTISRDNAKNSLYLQMNSLR ADDTAVYYCAREAPLRLGESPHDAFDISG QGTMVTVSS |
| 1.66b | DSSMT SEQ NO. 776 | YISSGGG VKFYTDS VKG SEQ NO. 777 | EAPLRLG ESPHDAF DT SEQ NO. 778 | SEQ NO. 779 QVQLVESGGGLVKPGGSLRLSCAASGFTF SDSSMTWMRQAPGKGLEWVSYISSGGGV KFYTDSVKGRFTISRDNAKNSLYLQMDSLR ADDTAVYYCAREAPLRLGESPHDAFDTSG QGTMVTVSS |
| 1.67b | GSSMT SEQ NO. 780 | YISSGGG VIFYADSV KG SEQ NO. 781 | EAPLRLG ESPHDAF DI SEQ NO. 782 | SEQ NO. 783 QVQLVESGGGLVKPGGSLRLSCAASGFTF SGSSMTWMRQAPGKGLEWVSYISSGGGV IFYADSVKGRFTISRDNAKNSLYLQMNSLR ADDTAVYYCAREAPLRLGESPHDAFDISG QGTMVTVSS |
| 1.68b | DNSMT SEQ NO. 784 | YISSGGG VIFYADSV KG SEQ NO. 785 | EAPLRLG ESPHDAF DI SEQ NO. 786 | SEQ NO. 787 QVQLVESGGGLVKPGGSLRLSCAASGFTF GDNSMTWMRQAPGKGLEWVSYISSGGGV IFYADSVKGRFTISRDNAKNSLYLQMNSLR ADDTAVYYCAREAPLRLGESPHDAFDISGR GTTVTVSS |
| 1.69b | DNSM S SEQ NO. 788 | YISSGGG VIFYADSV KG SEQ NO. 789 | EAPLRLG ESPHDAF DI SEQ NO. 790 | SEQ NO. 791 QVQLVESGGGLVKPGGSLRLSCAASGFTF SDNSMSWMRQAPGKGLEWVSYISSGGGV IFYADSVKGRFTISRDNAKNSLYLQMNSLR ADDTAVYYCAREAPLRLGESPHDAFDISG QGTMVTVSS |
| 1.70b | DSSMT SEQ NO. 792 | YISSGGA VKFYTDS VKG SEQ NO. 793 | EAPLRLG ESPHDAF DI SEQ NO. 794 | SEQ NO. 795 QVQLVESGGGLVKPGGSLRLSCAASGFTF GDSSMTWMRQAPGKGLEWVSYISSGGAV KFYTDSVKGRFTISRDNAKNSLYLQMNSLR ADDTAVYYCAREAPLRLGESPHDAFDISG QGTMVTVSS |
| 1.71b | GSSMT SEQ NO. 796 | YISSGGG VKFYTDS VKG SEQ NO. 797 | EAPLRLG ESPHDAF DI SEQ NO. 798 | SEQ NO. 799 QVQLVESGGGLVKPGGSLRLSCAASGFTF GGSSMTWMRQAPGKGLEWVSYISSGGGV KFYTDSVKGRFTISRDNAKNSLYLQMNSLR ADDTAVYYCAREAPLRLGESPHDAFDISG QGTMVTVSS |
| 1.72b | DSSMS SEQ NO. 800 | YISSGGG VIFYADSV KG SEQ NO. 801 | EAPLRLG ESPHDAF DI SEQ NO. 802 | SEQ NO. 803 QVQLVESGGGLVKPGGSLRLSCAASGFTF SDSSMSWMRQAPGKGLEWVSYISSGGGV IFYADSVKGRFTISRDNAKNSLYLQMNSLR ADDTAVYYCAREAPLRLGESPHDAFDISG QGTMVTVSS |
| 1.73b | DSSMT SEQ NO. 804 | YISAGGG VRFYTDS VKG SEQ NO. 805 | EAPLRLG ESPHDAF DI SEQ NO. 806 | SEQ NO. 807 QVQLVESGGGLVKPGGSLRLSCAATGFTF SDSSMTWMRQAPGKGLEWVSYISAGGGV RFYTDSVKGRFTISRDNAKNSLYLQMNSLR ADDTAVYYCAREAPLRLGESPHDAFDISG QGTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.74b | SEQ ID NO: 881 YISSGGGVKFYTDSDSSMT | SEQ ID NO: 882 YISSGGGVKFYTDSVKG | SEQ ID NO: 883 EAPLRLGESPHDAFDI | SEQ ID NO: 884 EVQLVESGGGLVKPGGSLRLSCAASGFTFSDSSMTWIRQAPGKGLEWVSYISSGGGVKFYTDSVKGRFTISRDNAKNSLYLQMNSLRADDTAVYYCAREAPLRLGESPHDAFDISGQGTMVTVSS |
| 1.75b | SEQ ID NO: 885 YISSGGGVKFYTDSDSSMT | SEQ ID NO: 886 YISSGGGVKFYTDSVKG | SEQ ID NO: 887 EAPLRLGESPHDAFDI | SEQ ID NO: 888 EVQLVESGGGLVKPGGSLRLSCAASGFTFSDSSMTWIRQAPGKGLEWVSYISSGGGVKFYTDSVKGRFTISRDNAKNSLYLQMNSLRAEDTAVYYCAREAPLRLGESPHDAFDISGQGTMVTVSS |
| 1.76b | SEQ ID NO: 889 YISSGGGVKFYADSDSSMT | SEQ ID NO: 890 YISSGGGVKFYADSVKG | SEQ ID NO: 891 EAPLRLGESPHDAFDI | SEQ ID NO: 892 EVQLVESGGGLVKPGGSLRLSCAASGFTFSDSSMTWIRQAPGKGLEWVSYISSGGGVKFYADSVKGRFTISRDNAKNSLYLQMNSLRADDTAVYYCAREAPLRLGESPHDAFDISGQGTMVTVSS |
| 1.77b | SEQ ID NO: 893 YISSGGGVKFYTDSDSSMT | SEQ ID NO: 894 YISSGGGVKFYTDSVKG | SEQ ID NO: 895 EAPLRLGESPHDAFDI | SEQ ID NO: 896 EVQLVESGGGLVKPGGSLRLSCAASGFTFSDSSMTWMRQAPGKGLEWVSYISSGGGVKFYTDSVKGRFTISRDNAKNSLYLQMNSLRAEDTAVYYCAREAPLRLGESPHDAFDISGQGTMVTVSS |
| 1.78b | SEQ ID NO: 897 YISSGGGVKFYADSDSSMT | SEQ ID NO: 898 YISSGGGVKFYADSVKG | SEQ ID NO: 899 EAPLRLGESPHDAFDI | SEQ ID NO: 900 EVQLVESGGGLVKPGGSLRLSCAASGFTFSDSSMTWIRQAPGKGLEWVSYISSGGGVKFYADSVKGRFTISRDNAKNSLYLQMNSLRAEDTAVYYCAREAPLRLGESPHDAFDISGQGTMVTVSS |
| 1.79b | SEQ ID NO: 901 YISSGGGVKFYADSDSSMT | SEQ ID NO: 902 YISSGGGVKFYADSVKG | SEQ ID NO: 903 EAPLRLGESPHDAFDI | SEQ ID NO: 904 EVQLVESGGGLVKPGGSLRLSCAASGFTFSDSSMTWKRQAPGKGLEWVSYISSGGGVKFYADSVKGRFTISRDNAKNSLYLQMNSLRAEDTAVYYCAREAPLRLGESPHDAFDISGQGTMVTVSS |
| 1.80b | SEQ ID NO: 905 YISSGGGVKFYADSDSSMT | SEQ ID NO: 906 YISSGGGVKFYADSVKG | SEQ ID NO: 907 EAPLRLGESPHDAFDI | SEQ ID NO: 908 EVQLVESGGGLVKPGGSLRLSCAASGFTFSDSSMTWMRQAPGKGLEWVSYISSGGGVKFYADSVKGRFTISRDNAKNSLYLQMNSLRAEDTAVYYCAREAPLRLGESPHDAFDISGQGTMVTVSS |
| 1.81b | SEQ ID NO: 909 YISSGGGVKFYADSDSSMT | SEQ ID NO: 910 YISSGGGVKFYADSVKG | SEQ ID NO: 911 EAPLRLGESPHDAFDI | SEQ ID NO: 912 EVQLVESGGGLVKPGGSLRLSCAASGFTFSDSSMTWVRQAPGKGLEWVSYISSGGGVKFYADSVKGRFTISRDNAKNSLYLQMNSLRAEDTAVYYCAREAPLRLGESPHDAFDISGQGTMVTVSS |
| 1.82b | SEQ ID NO: 913 YISSGGGVKFYTDSDTSMT | SEQ ID NO: 914 YISSGGGVKFYTDSVKG | SEQ ID NO: 915 EAPLRLGESPHDAFDI | SEQ ID NO: 916 EVQLVESGGGLVKPGGSLRLSCAASGFTFSDTSMTWMRQAPGKGLEWVSYISSGGGVKFYTDSVKGRFTISRDNAKNSLYLQMNSLRAEDTAVYYCAREAPLRLGESPHDAFDISGQGTMVTVSS |
| 1.83b | SEQ ID NO: 917 YISSGGGVKFYTDSDESMT | SEQ ID NO: 918 YISSGGGVKFYTDSVKG | SEQ ID NO: 919 EAPLRLGESPHDAFDI | SEQ ID NO: 920 EVQLVESGGGLVKPGGSLRLSCAASGFTFSDESMTWFRQAPGKGLEWVSYISSGGGVKFYTDSVKGRFTISRDNAKNSLYLQMNSLRAEDTAVYYCAREAPLRLGESPHDAFDISGQGTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.84b | SEQ ID NO: 921 YISSGGGVKFYTDSDESMT | SEQ ID NO: 922 YISSGGGVKFYTDSVKG | SEQ ID NO: 923 EAPLRLGESPHDAFDI | SEQ ID NO: 924 EVQLVESGGGLVKPGGSLRLSCAASGFTFSDESMTWMRQAPGKGLEWVSYISSGGGVKFYTDSVKGRFTISRDNAKNSLYLQMNSLRAEDTAVYYCAREAPLRLGESPHDAFDISGQGTMVTVSS |
| 1.85b | SEQ ID NO: 925 YISSGGGVKFYTDSDYSMT | SEQ ID NO: 926 YISSGGGVKFYTDSVKG | SEQ ID NO: 927 EAPLRLGESPHDAFDI | SEQ ID NO: 928 EVQLVESGGGLVKPGGSLRLSCAASGFTFSDYSMTWMRQAPGKGLEWVSYISSGGGVKFYTDSVKGRFTISRDNAKNSLYLQMNSLRAEDTAVYYCAREAPLRLGESPHDAFDISGQGTMVTVSS |
| 1.86b | SEQ ID NO: 929 YISSGGGVKFYTDSDASMT | SEQ ID NO: 930 YISSGGGVKFYTDSVKG | SEQ ID NO: 931 EAPLRLGESPHDAFDI | SEQ ID NO: 932 EVQLVESGGGLVKPGGSLRLSCAASGFTFSDASMTWMRQAPGKGLEWVSYISSGGGVKFYTDSVKGRFTISRDNAKNSLYLQMNSLRAEDTAVYYCAREAPLRLGESPHDAFDISGQGTMVTVSS |
| 1.87b | SEQ ID NO: 933 YISSGGGVKFYTDSDKSMT | SEQ ID NO: 934 YISSGGGVKFYTDSVKG | SEQ ID NO: 935 EAPLRLGESPHDAFDI | SEQ ID NO: 936 EVQLVESGGGLVKPGGSLRLSCAASGFTFSDKSMTWMRQAPGKGLEWVSYISSGGGVKFYTDSVKGRFTISRDNAKNSLYLQMNSLRAEDTAVYYCAREAPLRLGESPHDAFDISGQGTMVTVSS |
| 1.88b | SEQ ID NO: 937 YISSGGGVKFYTDSDRSMT | SEQ ID NO: 938 YISSGGGVKFYTDSVKG | SEQ ID NO: 939 EAPLRLGESPHDAFDI | SEQ ID NO: 940 EVQLVESGGGLVKPGGSLRLSCAASGFTFSDRSMTWMRQAPGKGLEWVSYISSGGGVKFYTDSVKGRFTISRDNAKNSLYLQMNSLRAEDTAVYYCAREAPLRLGESPHDAFDISGQGTMVTVSS |
| 1.89b | SEQ ID NO: 941 YISSGGGVKFYADSDYSMT | SEQ ID NO: 942 YISSGGGVKFYADSVKG | SEQ ID NO: 943 EAPLRLGESPHDAFDI | SEQ ID NO: 944 EVQLVESGGGLVKPGGSLRLSCAASGFTFSDYSMTWMRQAPGKGLEWVSYISSGGGVKFYADSVKGRFTISRDNAKNSLYLQMNSLRAEDTAVYYCAREAPLRLGESPHDAFDISGQGTMVTVSS |
| 1.90b | SEQ ID NO: 945 YISSGGGVKFYADSDVSMT | SEQ ID NO: 946 YISSGGGVKFYADSVKG | SEQ ID NO: 947 EAPLRLGESPHDAFDI | SEQ ID NO: 948 EVQLVESGGGLVKPGGSLRLSCAASGFTFSDVSMTWMRQAPGKGLEWVSYISSGGGVKFYADSVKGRFTISRDNAKNSLYLQMNSLRAEDTAVYYCAREAPLRLGESPHDAFDISGQGTMVTVSS |
| 1.91b | SEQ ID NO: 949 YISSGGGVKFYADSDQSMT | SEQ ID NO: 950 YISSGGGVKFYADSVKG | SEQ ID NO: 951 EAPLRLGESPHDAFDI | SEQ ID NO: 952 EVQLVESGGGLVKPGGSLRLSCAASGFTFSDQSMTWMRQAPGKGLEWVSYISSGGGVKFYADSVKGRFTISRDNAKNSLYLQMNSLRAEDTAVYYCAREAPLRLGESPHDAFDISGQGTMVTVSS |
| 1.92b | SEQ ID NO: 953 YISSGGGVKFYADSDESMT | SEQ ID NO: 954 YISSGGGVKFYADSVKG | SEQ ID NO: 955 EAPLRLGESPH DAFDI | SEQ ID NO: 956 EVQLVESGGGLVKPGGSLRLSCAASGFTFSDESMTWMRQAPGKGLEWVSYISSGGGVKFYADSVKGRFTISRDNAKNSLYLQMNSLRAEDTAVYYCAREAPLRLGESPHDAFDISGQGTMVTVSS |
| 1.93b | SEQ ID NO: 957 YISSGGGVKFYADSDASMT | SEQ ID NO: 958 YISSGGGVKFYADSVKG | SEQ ID NO: 959 EAPLRLGESPH DAFDI | SEQ ID NO: 960 EVQLVESGGGLVKPGGSLRLSCAASGFTFSDASMTWMRQAPGKGLEWVSYISSGGGVKFYADSVKGRFTISRDNAKNSLYLQMNSLRAEDTAVYYCAREAPLRLGESPHDAFDISGQGTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.94b | SEQ ID NO: 961 YISSGGGDWSMT | SEQ ID NO: 962 YISSGGGVKFYADS VKG | SEQ ID NO: 963 EAPLRLG ESPHDAF DI | SEQ ID NO: 964 EVQLVESGGGLVKPGGSLRLSCAASGFTF SDWSMTWMRQAPGKGLEWVSYISSGGG VKFYADSVKGRFTISRDNAKNSLYLQMNSL RAEDTAVYYCAREAPLRLGESPHDAFDISG QGTMVTVSS |
| 1.95b | SEQ ID NO: 965 YISSGGGDGSMT | SEQ ID NO: 966 YISSGGGVKFYADS VKG | SEQ ID NO: 967 EAPLRLG ESPH DAF DI | SEQ ID NO: 968 EVQLVESGGGLVKPGGSLRLSCAASGFTF SDGSMTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.96b | SEQ ID NO: 969 YISSGGGDTSMT | SEQ ID NO: 970 YISSGGGVKFYADS VKG | SEQ ID NO: 971 EAPLRLG ESPH DAF DI | SEQ ID NO: 972 EVQLVESGGGLVKPGGSLRLSCAASGFTF SDTSMTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.97b | SEQ ID NO: 973 YISSGGGDISMT | SEQ ID NO: 974 YISSGGGVKFYADS VKG | SEQ ID NO: 975 EAPLRLG ESPHDAF DI | SEQ ID NO: 976 EVQLVESGGGLVKPGGSLRLSCAASGFTF SDISMTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.98b | SEQ ID NO: 977 YISSGGGDKSMT | SEQ ID NO: 978 YISSGGGVKFYADS VKG | SEQ ID NO: 979 EAPLRLG ESPH DAF DI | SEQ ID NO: 980 EVQLVESGGGLVKPGGSLRLSCAASGFTF SDKSMTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.99b | SEQ ID NO: 981 YISSGGGDRSMT | SEQ ID NO: 982 YISSGGGVKFYADS VKG | SEQ ID NO: 983 EAPLRLG ESPHDAF DI | SEQ ID NO: 984 EVQLVESGGGLVKPGGSLRLSCAASGFTF SDRSMTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.100 b | SEQ ID NO: 985 YISSGGGDLSMT | SEQ ID NO: 986 YISSGGGVKFYADS VKG | SEQ ID NO: 987 EAPLRLG ESPHDAF DI | SEQ ID NO: 988 EVQLVESGGGLVKPGGSLRLSCAASGFTF SDLSMTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.101 b | SEQ ID NO: 989 YISSGGGDFSMT | SEQ ID NO: 990 YISSGGGVKFYADS VKG | SEQ ID NO: 991 EAPLRLG ESPHDAF DI | SEQ ID NO: 992 EVQLVESGGGLVKPGGSLRLSCAASGFTF SDFSMTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.102 b | SEQ ID NO: 993 YISSGGGDESVT | SEQ ID NO: 994 YISSGGGVKFYTDS VKG | SEQ ID NO: 995 EAPLRLG ESPHDAF DI | SEQ ID NO: 996 EVQLVESGGGLVKPGGSLRLSCAASGFTF SDESVTWMRQAPGKGLEWVSYISSGGGV KFYTDSVKGRFTISRDNAKNSLYLQMNSLR AEDTAVYYCAREAPLRLGESPHDAFDISGQ GTMVTVSS |
| 1.103 b | SEQ ID NO: 997 YISSGGGDESQT | SEQ ID NO: 998 YISSGGGVKFYTDS VKG | SEQ ID NO: 999 EAPLRLG ESPHDAF DI | SEQ ID NO: 1000 EVQLVESGGGLVKPGGSLRLSCAASGFTF SDESQTWMRQAPGKGLEWVSYISSGGGV KFYTDSVKGRFTISRDNAKNSLYLQMNSLR AEDTAVYYCAREAPLRLGESPHDAFDISGQ GTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.104 b | SEQ ID NO: 1001 YISSGGG VKFYTDS DESFT | SEQ ID NO: 1002 EAPLRLG VKG | SEQ ID NO: 1003 ESPHDAF DI | SEQ ID NO: 1004 EVQLVESGGGLVKPGGSLRLSCAASGFTF SDESFIVVMRQAPGKGLEWVSYISSGGGV KFYTDSVKGRFTISRDNAKNSLYLQMNSLR AEDTAVYYCAREAPLRLGESPHDAFDISGQ GTMVTVSS |
| 1.105 b | SEQ ID NO: 1005 YISSGGG VKFYTDS DESLT | SEQ ID NO: 1006 EAPLRLG VKG | SEQ ID NO: 1007 ESPHDAF DI | SEQ ID NO: 1008 EVQLVESGGGLVKPGGSLRLSCAASGFTF SDESLTWMRQAPGKGLEWVSYISSGGGV KFYTDSVKGRFTISRDNAKNSLYLQMNSLR AEDTAVYYCAREAPLRLGESPHDAFDISGQ GTMVTVSS |
| 1.106 b | SEQ ID NO: 1009 YISSGGG VKFYTDS DESKT | SEQ ID NO: 1010 EAPLRLG VKG | SEQ ID NO: 1011 ESPHDAF DI | SEQ ID NO: 1012 EVQLVESGGGLVKPGGSLRLSCAASGFTF SDESKTWMRQAPGKGLEWVSYISSGGGV KFYTDSVKGRFTISRDNAKNSLYLQMNSLR AEDTAVYYCAREAPLRLGESPHDAFDISGQ GTMVTVSS |
| 1.107 b | SEQ ID NO: 1013 YISSGGG VKFYTDS DESYT | SEQ ID NO: 1014 EAPLRLG VKG | SEQ ID NO: 1015 ESPHDAF DI | SEQ ID NO: 1016 EVQLVESGGGLVKPGGSLRLSCAASGFTF SDESYTWMRQAPGKGLEWVSYISSGGGV KFYTDSVKGRFTISRDNAKNSLYLQMNSLR AEDTAVYYCAREAPLRLGESPHDAFDISGQ GTMVTVSS |
| 1.108 b | SEQ ID NO: 1017 YISSGGG VKFYADS DESAT | SEQ ID NO: 1018 EAPLRLG VKG | SEQ ID NO: 1019 ESPHDAF DI | SEQ ID NO: 1020 EVQLVESGGGLVKPGGSLRLSCAASGFTF SDESATWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.109 b | SEQ ID NO: 1021 YISSGGG VKFYADS DESFT | SEQ ID NO: 1022 EAPLRLG VKG | SEQ ID NO: 1023 ESPHDAF DI | SEQ ID NO: 1024 EVQLVESGGGLVKPGGSLRLSCAASGFTF SDESFTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.110 b | SEQ ID NO: 1025 YISSGGG VKFYADS DESNT | SEQ ID NO: 1026 EAPLRLG VKG | SEQ ID NO: 1027 ESPHDAF DI | SEQ ID NO: 1028 EVQLVESGGGLVKPGGSLRLSCAASGFTF SDESNTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.111 b | SEQ ID NO: 1029 YISSGGG VKFYADS DESWT | SEQ ID NO: 1030 EAPLRLG VKG | SEQ ID NO: 1031 ESPHDAF DI | SEQ ID NO: 1032 EVQLVESGGGLVKPGGSLRLSCAASGFTF SDESWTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.112 b | SEQ ID NO: 1033 YISSGGG VKFYADS DESIT | SEQ ID NO: 1034 EAPLRLG VKG | SEQ ID NO: 1035 ESPHDAF DI | SEQ ID NO: 1036 EVQLVESGGGLVKPGGSLRLSCAASGFTF SDESITWMRQAPGKGLEWVSYISSGGGVK FYADSVKGRFTISRDNAKNSLYLQMNSLRA EDTAVYYCAREAPLRLGESPHDAFDISGQ GTMVTVSS |
| 1.113 b | SEQ ID NO: 1037 YISSGGG VKFYADS DESST | SEQ ID NO: 1038 EAPLRLG VKG | SEQ ID NO: 1039 ESPHDAF DI | SEQ ID NO: 1040 EVQLVESGGGLVKPGGSLRLSCAASGFTF SDESSTWMRQAPGKGLEWVSYISSGGGV KFYADSVKGRFTISRDNAKNSLYLQMNSLR AEDTAVYYCAREAPLRLGESPHDAFDISGQ GTMVTVSS |

TABLE 2-continued

Full length sequences and CDR sequences of the second
VH single domain; i.e. VH single domain that blocks
ligand binding to PD-1.

| Clone name | CDR1 | CDR2 | CDR3 | Full length VH |
|---|---|---|---|---|
| 1.114 b | SEQ ID NO: 1041 DESHT | SEQ ID NO: 1042 YISSGGG VKFYADS VKG | SEQ ID NO: 1043 EAPLRLG ESPHDAF DI | SEQ ID NO: 1044 EVQLVESGGGLVKPGGSLRLSCAASGFTF SDESHTWMRQAPGKGLEWVSYISSGGGV KFYADSVKGRFTISRDNAKNSLYLQMNSLR AEDTAVYYCAREAPLRLGESPHDAFDISGQ GTMVTVSS |
| 1.115 b | SEQ ID NO: 1045 DESGT | SEQ ID NO: 1046 YISSGGG VKFYADS VKG | SEQ ID NO: 1047 EAPLRLG ESPHDAF DI | SEQ ID NO: 1048 EVQLVESGGGLVKPGGSLRLSCAASGFTF SDESGTWMRQAPGKGLEWVSYISSGGGV KFYADSVKGRFTISRDNAKNSLYLQMNSLR AEDTAVYYCAREAPLRLGESPHDAFDISGQ GTMVTVSS |

In some embodiments, the first or second $V_H$ single domain antibody used in the binding agent of the invention is a variant of any single $V_H$ domain antibodies in table 1 or 2 having one or more amino acid substitution, deletion, insertion or other amino acid modification, and which retains a biological function of the single domain antibody in the biparatopic molecule. A variant $V_H$ single domain antibody can be sequence engineered. Suitable modifications include one or more substitution, deletion or insertion of one or more codons in a nucleic acid encoding the single domain antibody or polypeptide that results in a change in the amino acid sequence as compared with the native sequence $V_H$ single domain antibody or polypeptide. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence. A variant of a $V_H$ single domain antibody described herein has at least 75%, 76%, 77%, 78%, 79%, 8 0%, 81%, 82%, 83%, 84%, 85%, 86%, 87%, 88%, 89%, 90%, 91%, 92%, 93%, 94%, 95%, 96%, 97%, 98% or 99% sequence homology to the non-variant molecule, preferably at least 90%, 91%, 92%, 93%, 94%, 95%, 96%, 97%, 98% or 99% sequence homology.

In one embodiment, the modification is a conservative sequence modification. As used herein, the term "conservative sequence modifications" is intended to refer to amino acid modifications that do not significantly affect or alter the binding characteristics of the antibody containing the amino acid sequence. Such conservative modifications include amino acid substitutions, additions and deletions. Modifications can be introduced into an antibody of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within the CDR regions of a single domain antibody used in the invention can be replaced with other amino acid residues from the same side chain family and the altered antibody can be tested for retained function (i.e., the functions set forth in (c) through (I) above) using the functional assays described herein.

In some embodiments, the first and/or second $V_H$ single domain antibody is a variant of a single domain antibody selected from those shown in Table 1 and/or 2 that comprises one or more amino acid sequence modification and has improvements in one or more of a property such as binding affinity, specificity, thermostability, expression level, effector function, glycosylation, reduced immunogenicity, or solubility as compared to the unmodified single domain antibody.

A skilled person will know that there are different ways to identify, obtain and optimise the antigen binding molecules as described herein, including in vitro and in vivo expression libraries. This is further described in the examples. Optimisation techniques known in the art, such as display (e.g., ribosome and/or phage display) and/or mutagenesis (e.g., error-prone mutagenesis) can be used. The invention therefore also comprises sequence optimised variants of the single domain antibodies described herein.

In one embodiment, modifications can be made to decrease the immunogenicity of the single domain antibody. For example, one approach is to revert one or more framework residues to the corresponding human germline sequence. More specifically, a single domain antibody that has undergone somatic mutation may contain framework residues that differ from the germline sequence from which the single domain antibody is derived. Such residues can be identified by comparing the single domain antibody framework sequences to the germline sequences from which the single domain antibody is derived.

To return one or more of the amino acid residues in the framework region sequences to their germline configuration, the somatic mutations can be "backmutated" to the germline sequence by, for example, site-directed mutagenesis or PCR-mediated mutagenesis.

Another type of framework modification involves mutating one or more residues within the framework region, or even within one or more CDR regions, to remove T cell epitopes to thereby reduce the potential immunogenicity of the antibody.

In still another embodiment, the glycosylation of an antibody is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen.

Thus, these amino acid changes can typically be made without altering the biological activity, function, or other desired property of the polypeptide, such as its affinity or its specificity for antigen. In general, single amino acid substitutions in nonessential regions of a polypeptide do not substantially alter biological activity. Furthermore, substitutions of amino acids that are similar in structure or function are less likely to disrupt the polypeptides' biological activity. Abbreviations for the amino acid residues that comprise polypeptides and peptides described herein, and conservative substitutions for these amino acid residues are shown in Table 3 below.

TABLE 3

Amino Acid Residues and Examples of
Conservative Amino Acid Substitutions

| Original residue Three letter code, single letter code | Conservative substitution |
|---|---|
| Alanine, Ala, A | Gly, Ser |
| Arginine, Arg, R | Lys, His |
| Asparagine, Asn, N | Gln, His |
| Aspartic acid Asp, D | Glu, Asn |
| Cysteine, Cys, C | Ser, Ala |
| Glutamine, Gln, Q | Asn |
| Glutamic acid, Glu, E | Asp, Gln |
| Glycine, Gly, G | Ala |
| Histidein, His, H | Asn, Gln |
| Isoleucine, Ile, I | Leu, Val |
| Leucine, Leu, L | Ile, Val |
| Lysine, lys, K | Ar, His |
| Methionine, Met, M | Leu, Ile, Tyr |
| Phenylalanine, Phe, F | Tyr, Met, Leu |
| Proline, Pro, P | Ala |
| Serine, Ser, S | Thr |
| Threonine, Thr, T | Ser |
| Tryptophan, Trp, W | Tyr, Phe |
| Tyrosine, Tyr, Y | Try, Phe |
| Valine, Val, V | Ile, Leu |

In one embodiment, the variant first $V_H$ single domain antibody is selected from any one of the $V_H$ sequences shown in table 1 or 2, but comprises one or more amino acid substitutions, for example 1, 2, 3, 4, 5, 6, 7, 8, 9 or 10 amino acid substitutions. In one embodiment, the one or more amino acid substitution is in one or more of the framework areas. In another embodiment, the one or more amino acid substitution is in one or more of the CDRs. In one embodiment, the amino acid substitutions are in the framework and CDR sequences. In one embodiment, the first $V_H$ single domain antibody comprises or consists of SEQ ID No. 4 or a sequence which comprises one or more amino acid substitutions, for example 1, 2, 3, 4, 5, 6, 7, 8, 9 or 10 amino acid substitutions or SEQ ID No. 254 or a sequence which comprises one or more amino acid substitutions, for example 1, 2, 3, 4, 5, 6, 7, 8, 9 or 10 amino acid substitutions.

In one embodiment, the variant first $V_H$ single domain antibody comprises SEQ ID No. 4 with amino acid substitutions at one of the following positions: 5L, 32H, 44G, 55S, 66D, 77S and/or 105T. In one embodiment, the first $V_H$ single domain antibody comprises SEQ ID No. 4 (1.1a in Table 1) with amino acid substitutions selected from one of the following:
  a) 5L→V, 11S→L, 32H→Y, 44G→D, 55S→G, 62D→A, 66D→G and 77S→N or
  b) 5L→V, 11S→L, 32H→N, 44G→D, 55S→G, 66D→G and 77S→N or
  c) 1E→Q, 5L→V, 11S→L, 32H→N, 44G→D, 55S→G, 66D→G, 77S→N, 98R→K, 99E→D105T→I and 102M→T.

In one embodiment, the variant first $V_H$ single domain antibody comprises SEQ ID No. 136 with amino acid substitutions at one or more or all of the following positions: M34, M58, V116, V102. In one embodiment, the first $V_H$ single domain antibody comprises SEQ ID No 136 with amino acid substitutions selected from one of the following:
  a) M34→L, M58→Y, V116A (Humabody® 1.39a)
  b) M34→F, G54→A, M58→Q, V102A (Humabody® 1.50a)
  c) V116A (Humabody® 1.26a)
  d) M34→L, M58→Q, V116A (Humabody® 1.40a)

In one embodiment, the variant first $V_H$ single domain antibody comprises SEQ ID No. 254 with amino acid substitutions at one or more or all of the following positions: G 109, D66, G55. In one embodiment, the first $V_H$ single domain antibody comprises SEQ ID No 254 with amino acid substitutions selected from one of the following:
  a) G109→D, D66→G, G55→A (Humabody® 1.62a)
  b) G109→D, G55→A (Humabody® 1.77a)
  c) G109→D (Humabody® 2.53)
  d) G109→D, D66→G (Humabody® 1.79a)
  e) G109→V, D66→G (Humabody® 1.103a)

In one embodiment, the variant second $V_H$ single domain antibody is selected from any one of the sequences shown in table 2, but comprises one or more amino acid substitutions, for example 1, 2, 3, 4, 5, 6, 7, 8, 9 or 10 amino acid substitutions. In one embodiment, the variant $V_H$ single domain antibody is selected from SEQ ID No. 519 or 743. In one embodiment, the variant $V_H$ single domain antibody is selected from SEQ ID No. 956. In one embodiment, the one or more amino acid substitution is in one or more of the framework areas. In another embodiment, the one or more amino acid substitution is in one or more of the CDRs. In one embodiment, the amino acid substitutions are in the framework and CDR sequences. In one embodiment, the second $V_H$ single domain antibody comprises or consists of SEQ ID No. 519, 743 or 771 or a sequence which comprises one or more amino acid substitutions, for example 1, 2, 3, 4, 5, 6, 7, 8, 9 or 10 amino acid substitutions.

In one embodiment, the variant second $V_H$ single domain antibody comprises SEQ ID No. 519 (Humabody® 1.1b) but with amino acid substitutions at one or more or all of the following positions: Y32, T33, T53, T56, I57, K58, Y59, T61 and/or W115.

In one embodiment, the variant second $V_H$ single domain antibody comprises SEQ ID No. 519 (1.1b as in Table 2) but with the following amino acid substitutions: Y32→N, T33→S, T53→S, T56→G, I57→V, K58→I, Y59→F, W115→S (1.57b as in Table 2).

In one embodiment, the variant second $V_H$ single domain antibody comprises SEQ ID No. 743 (Humabody® 1.57b) but with amino acid substitutions at one or more or all of the following positions: D31, N32, I58, A61, T35, S30, G56, S25Q117, M120 and/or Q1.

In one embodiment, the variant second $V_H$ single domain antibody comprises SEQ ID No. 743 (1.57b as in Table 2) but with amino acid substitutions selected from one of the following
1) D31→G, N32→S (1.67b as in Table 2);
2) S30→G, D31→G, N32→S, I58→K, A61→T (1.71b as in Table 2);
3) T35→S (1.69b as in Table 2);
4) S30→G, N32→S, G56→A, I58→K, A61→T (1.70b as in Table 2);
5) S25→T, N32→S, I58→R, A61→T (1.73b as in Table 2);
6) N32→S, I58→K, A61→T, N84→D, I114→T (1.66b as in Table 2);
7) S30→G, Q117→R, M120→T (1.68b as in Table 2);
8) N32→S, T35→S (1.72b as in Table 2);
9) N32→SG56→A, I58→K, A61→T (1.62b as in Table 2);
10) N32→S, I58→K (1.65b as in Table 2);
11) Q1→E, N32→S, I58→K (1.64b as in Table 2);
12) Q1→E, N32→S, I58→K, A61→T (1.63b as in Table 2).

In one embodiment, the variant second $V_H$ single domain antibody comprises SEQ ID No. 771 (Humabody® 1.64b) but with amino acid substitutions at one or more or all of the following positions: S32, D90 and/or A60.

In one embodiment, the variant second $V_H$ single domain antibody comprises SEQ ID No. 771 (Humabody® 1.64b) but with amino acid substitutions selected from one of the following:
1. S32→E, D90→E (Humabody® 1.92b);
2. S32→R, D90→E (Humabody® 1.99b);
3. S32→Y, D90→E (Humabody® 1.89b);
4. S32→E, D90→E, A61→T (Humabody® 1.84b);
5. D85→E A60→T (Humabody® 1.77b);
6. S32→T, D90→E A60→T (Humabody® 1.82b);

The numbering above reflects the actual position of the residue in the protein.

The binding agents of the invention preferably have KD and $EC_{50}$ values as further described herein and as shown in the examples.

The term "KD" refers to the "equilibrium dissociation constant" and refers to the value obtained in a titration measurement at equilibrium, or by dividing the dissociation rate constant (Koff) by the association rate constant (Kon). "KA" refers to the affinity constant. The association rate constant, the dissociation rate constant and the equilibrium dissociation constant are used to represent the binding affinity of an antibody to an antigen. Methods for determining association and dissociation rate constants are well known in the art. Using fluorescence-based techniques offers high sensitivity and the ability to examine samples in physiological buffers at equilibrium. Other experimental approaches and instruments such as a BIAcore® (biomolecular interaction analysis) assay can be used.

In one embodiment, a single domain antibody/binding agent according to the invention has a KD value in the nanomolar to picomolar range.

In one embodiment, the biparatopic binding agent of the invention comprising a first non-neutralising $V_H$ single domain antibody and a second neutralising $V_H$ single domain antibody provides improved properties compared to said monovalent neutralising single domain antibody. For example, the biparatopic binding agent may have an enhanced, additive or synergistic effect. In another embodiment, blocking activity a biparatopic binding molecule is enhanced 10 to 25 fold, for example, 1, 2, 3, 4, 5, 6, 7, 8, 9, 10, 11, 12, 13, 14, 15, 16, 17, 18, 19, 20, 21, 22, 23, 24 or 25-fold compared to the monovalent blocking molecule. In another embodiment, tumour reduction can be enhanced, for example compared to a clinically validated benchmark antibody.

As further detailed in the examples, the inventors have observed that a multiparatopic binding agent as described herein exhibits beneficial properties, including the following: The binding agent
elicits average increases in CD4+ T cells, CD8+ T cells, with a decline in T regulatory cells and macrophages in a HuGEMM PD1 Model with Subcutaneous MC38 Mouse Colon Adenocarcinoma compared to a negative (non-PD-1-binding) control;
elicits average increases of cytokine release within said tumours, for example, interferon-gamma, IL-1α, IL-1β, IL-5, IL-6 and MIP-1α are increased relative to a negative control and a human PD-1 antibody treatment;
does not show average elevation of IL-6, IL-5, IL-12 and IL-1β in the serum relative to a human PD-1 antibody (which shows a mean increase of these cytokines compared to a negative control) treatment following treatment in a HuGEMM PD1 Model with Subcutaneous MC38 Mouse Colon Adenocarcinoma.

The present invention further provides an isolated nucleic acid construct encoding a binding agent of the present invention.

A nucleic acid sequences encoding a first single domain antibody is linked to a second nucleic acid encoding a second single domain antibody using for example a (G4S)n linker as described in the example. Nucleic acid sequences encoding a first single domain antibody are selected from SEQ ID Nos. SEQ ID Nos. 81 to 100 or 221 to 250 or 463 to 515. Nucleic acid sequences encoding a second single domain antibody are selected from SEQ ID Nos. 808 to 880 or 1049 to 1090.

In one embodiment, the nucleic acid sequence has at least 60%, 70%, 80%, 90%, 95% or more sequence homology to one of the nucleic acid sequences above. In one embodiment, said sequence homology is at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%.

In one embodiment, the binding molecule is selected from one of the following: 1.1b-(G4S)n-1.1a (SEQ ID NO. 519 linked to SEQ ID NO.4 with G4S linker); 1.57b-(G4S)n-1.1a (SEQ ID NO. 743 linked to SEQ ID NO.4 with G4S linker); 1.92b-(G4S)n-1.51a (SEQ ID NO. 956 linked to SEQ ID NO.254 with G4S linker); 1.92b-(G4S)n-1.62a (SEQ ID NO. 956 linked to SEQ ID NO. 298 with G4S linker); 1.92b-(G4S)n-1.99a (SEQ ID NO. 956 linked to SEQ ID NO.446 with G4S linker); 1.77b-(G4S)n-1.21a (SEQ ID NO. 896 linked to SEQ ID NO. 104 with G4S linker). For example, n=1, 2, 3, 4, 5, 6, 7, 8, 9, 10.

In one embodiment, the binding molecule is selected from one of the following: 1.1b-2GS-1.1a; 1.1b-4GS-1.1a; 1.1b-6G5-1.1a; 1.57b-4GS-1.1a; 1.57b-4GS-1.1a-4GS-MSA binder; 1.57-4GS-MSA binder-4GS-1.1a; 1.92b-4GS-1.51a; 1.92b-4GS-1.62a SEQ ID NO. 1114); 1.92b-4GS-1.39a (SEQ ID NO. 1112); 1.92b-4GS-1.99a; 1.77b-4GS-1.21a (SEQ ID NO. 1116); 1.77b-1GS-1.21a (SEQ ID NO. 1118) or 1.77b-2GS-1.21a (SEQ ID NO. 1120).

A nucleic acid according to the present invention may comprise DNA or RNA and may be wholly or partially synthetic or recombinantly produced. Reference to a nucleotide sequence as set out herein encompasses a DNA molecule with the specified sequence, and encompasses a RNA molecule with the specified sequence in which U is substituted for T, unless context requires otherwise.

Furthermore, the invention relates to a nucleic acid construct comprising at least one nucleic acid as defined above. The construct may be in the form of a plasmid, vector, transcription or expression cassette.

The invention also relates to an isolated recombinant host cell comprising one or more nucleic acid construct as described above. The host cell may be a bacterial, viral, yeast, insect, plant mammalian or other suitable host cell. In one embodiment, the cell is an *E. coli* cell. In another embodiment, the cell is a yeast cell. In another embodiment, the cell is a Chinese Hamster Ovary (CHO) cell.

In an embodiment, a method of making an anti-PD-1 binding agent as described herein is provided, wherein the method comprises culturing the host cell under conditions suitable for expression of the polynucleotide encoding the binding agent, and isolating the binding agent.

In another aspect, the invention provides a binding molecule comprising a) a PD-1 binding agent that binds to the same epitope on human PD-1 as any of the PD-1 first single domain antibodies described herein and b) a PD-1 binding agent that binds to the same epitope on human PD-1 as any of the PD-1 second single domain antibodies described herein.

Cross-competing antibodies can be identified based on their ability to cross-compete with a first single domain antibody selected from 1.1a to 1.103a in Table 1 or a second single domain antibody selected from 1.1b to 1.115b in Table 2 respectively in standard PD-1 binding assays. For example, BIAcore analysis, ELISA assays or flow cytometry may be used to demonstrate cross-competition with the single domain antibodies of the current invention.

In one aspect, the invention also relates to a combination or composition comprising a first single domain antibody as described herein and a second single domain antibody as described herein. In one aspect, the invention also relates to a combination therapy comprising administering first single domain antibody as described herein and a second single domain antibody as described herein. Administration may be simultaneously, separately or sequentially.

In one aspect, the binding agent of the invention comprises at least one further moiety. In one embodiment, the further moiety is a binding molecule, for example selected from an antibody or antibody fragment (e.g., a Fab, F(ab')2, Fv, a single chain Fv fragment (scFv) or single domain antibody, for example a $V_H$ domain) or antibody mimetic protein. In one embodiment, the further moiety is a $V_H$ domain. In one embodiment, the binding agent of the invention can be linked to an antibody Fc region or fragment thereof, comprising one or both of $C_H2$ and $C_H3$ domains, and optionally a hinge region.

In one embodiment, the PD-1 inhibitor is a $V_H$ single domain antibody.

Multiparatopic, for example biparatopic, and multivalent binding molecules of the present invention can be constructed using methods known in the art.

In certain embodiments, the binding agent is in the form of a multispecific, for example bispecific, binding agent providing multiple functionalities. Such multispecific agent comprises a single domain antibody that has a first binding specificity to PD-1 and at least one further binding molecule with a second binding specificity. Said further binding molecule can be selected from an antibody, an antibody fragment or antibody mimetic. In one embodiment, said antibody fragment is selected from F(ab')$_2$, Fab, Fv, sFv or domain antibody. In one embodiment, said antibody fragment is a $V_H$ single domain antibody.

In one embodiment, the binding agent is bispecific and comprises a biparatopic binding agent according to the invention that has a first binding and second specificity to PD-1 and further comprises a third binding molecule with a third binding specificity to a target other than PD-1. In one embodiment, the third binding molecule binds to an immunomodulatory agent, a checkpoint modulator, an agent involved in T-cell activation, a tumor microenvironment modifier (TME) or a tumour-specific target.

For example, the immunomodulator can be an inhibitor of an immune checkpoint molecule selected from an inhibitor of one or more of PD-L1, PD-L2, CTLA-4, TIM-3, LAG-3, CEACAM, VISTA, BTLA, TIGIT, LAIR1, CD160, 2B4 or TGFR beta. In another embodiment, the immunomodulator can be an activator of a costimulatory molecule selected from an agonist of one or more of IL-2, Il-12, OX40, OX40L, CD2, CD3, CD27, CDS, ICAM-1, LFA-1 (CD11a/CD18), ICOS (CD278), 4-1BB (CD137), GITR, CD30, CD40, BAFFR, HVEM, CD7, LIGHT, NKG2C, SLAMF7, NKp80, CD160, B7-H3, B7-H4 or CD83 ligand, CD3, CD8, CD28, CD4 or ICAM-1.

In one embodiment, the binding agent described above comprises further binding molecules. Thus, the binding agent can for example be trispecific or tetraspecific. Additional specificities are also envisaged. Any combination of the aforesaid molecules can be made in a multispecific binding agent, for example, a trispecific binding agent that includes a binding agent of the invention and a second or third binding specificity.

In another embodiment, the further moiety may serve to prolong the half-life of the binding molecule. The further moiety may comprise a protein, for example an antibody, or part thereof that binds a serum albumin, e.g., human serum albumin (HSA) or mouse serum albumin (MSA). The further moiety may comprise a $V_H$ domain that binds serum albumin, e.g., human serum albumin (HSA) or mouse serum albumin (MSA).

The further moiety may comprise a serum albumin, e.g. a human serum albumin (HSA) or a variant thereof such as HSA C34S. Further provided is binding molecule as described herein comprising a $V_H$ domain and an Fc domain, e.g., wherein the $V_H$ domain is fused to an Fc domain. Further provided is a binding molecule that comprises a third variable domain that specifically binds a third antigen, where the third antigen is an antigen other than human PD-1. The third antigen may be a cluster of differentiation (CD) molecule or a Major Histocompatibility Complex (MHC) Class II molecule.

In one embodiment, the binding agents of the invention are labelled with a detectable or functional label. A label can be any molecule that produces or can be induced to produce a signal, including but not limited to fluorophores, fluorescers, radiolabels, enzymes, chemiluminescers, a nuclear magnetic resonance active label or photosensitizers. Thus, the binding may be detected and/or measured by detecting fluorescence or luminescence, radioactivity, enzyme activity or light absorbance.

In still other embodiments, the binding agents of the invention are coupled to at least one therapeutic moiety, such as a drug, an enzyme or a toxin. In one embodiment, the therapeutic moiety is a toxin, for example a cytotoxic radionuclide, chemical toxin or protein toxin.

In another aspect, the multivalent binding agents of the invention are modified to increase half-life, for example by a chemical modification, especially by PEGylation, or by incorporation in a liposome or using a serum albumin protein.

Half-life may be increased by at least 1.5 times, preferably at least 2 times, such as at least 5 times, for example at least 10 times or more than 20 times, greater than the half-life of the corresponding $V_H$ single domain antibodies of the invention. For example, increased half-life may be more than 1 hours, preferably more than 2 hours, more preferably more than 6 hours, such as more than 12 hours, or even more than 24, 48 or 72 hours, compared to the corresponding $V_H$ single domain antibodies of the invention.

To generate a multivalent binding agents as described above, two binding molecules are connected by a linker, for example a polypeptide linker. Suitable linkers include for example a linker with GS residues such as $(Gly_4Ser)n$, where n=from 1 to 20 or 1 to 10, e.g., 1, 2, 3, 4, 5, 6, 7, 8, 9 or 10. In one embodiment n is 1, 2 or 3. In one embodiment n is 4 or more.

In one embodiment, the binding molecules can be used to induce PD-1 agonism. PD-1 signalling is induced by PD-L1 and leads to downregulation of T cell activity. One could say that something that induces PD-1 signalling is a 'PD1 agonist', which has contrasting effect to a T cell agonist. We provide evidence of a PD-1 engager that is capable of causing PD1 agonism in absence of a CD3 or T cell receptor clustering antibody.

An exemplary system to measure PD-1 agonism is a reporter cell line that shows a response when PD-1 signalling occurs. Thus, a binding molecule as described herein can provide agonistic function. Another aspect therefore relates to the use of a binding molecule described herein as an agonist.

A biparatopic molecule can enhance receptor cross-linking. A biparatopic molecule binds two epitopes on a single PD-1 monomer. Alternatively it can engage one arm with one PD1 molecule and the other arm with a second molecule. The second molecule still has an available epitope for a further biparatopic to engage and so a 'chain' of PD1 molecules can be clustered together. A shorter linker than $(Gly_4Ser)_4$ can prevent binding to a single molecule and can encourage cross-linking, thereby permitting PD1 agonism. In one embodiment, we provide a multivalent molecule, ideally with non-antagonistic function, joined by linkers of less than $(Gly_4Ser)_4$, preferably with at least 2 epitopes. In one embodiment n is 1, 2 or 3.

Our data shows a biparatopic format containing an antagonist and an anchor. Although this can induce PD-1 signalling, there is sufficient masking of the ligand-binding epitope to allow it to block ligand-induced signalling and have an antagonistic function.

A PD-1 agonist as described above is useful in the treatment of autoimmune and/or inflammatory and/or infectious diseases. Thus, another aspect relates to a PD-1 agonist as described above for use in the treatment of autoimmune and/or inflammatory and/or infectious diseases as well as methods for use in the treatment of autoimmune and/or inflammatory and/or infectious diseases comprising administration of a PD-1 agonist as described above.

Thus, there is provided an agonistic molecule comprising a $V_H$ single domain antibody which does not block the interaction between PD-1 and its ligands as described herein and a $V_H$ single domain antibody which blocks the interaction between PD-1 and its ligands as described herein connected with a linker selected from $(Gly_4Ser)n$ wherein n is 1, 2 or 3.

A binding agent described herein can be obtained by obtaining $V_H$ single domain antibodies from a transgenic rodent that expresses heavy chain only antibodies upon stimulation with a PD-1 antigen. The transgenic rodent, for example a mouse, preferably has a reduced capacity to express endogenous antibody genes. Thus, in one embodiment, the rodent has a reduced capacity to express endogenous light and/or heavy chain antibody genes. The rodent may therefore comprise modifications to disrupt expression of endogenous kappa and lambda light and/or heavy chain antibody genes so that no functional light and/or heavy chains are produced, for example as further explained below.

Human heavy chain only antibodies capable of binding human PD-1 that can be used in the biding agents of the invention can be produced by a method comprising
   a) immunising a transgenic rodent with an PD-1 antigen wherein said rodent expresses a nucleic acid construct comprising unrearranged human heavy chain V genes and is not capable of making functional endogenous light or heavy chains,
   b) isolating human heavy chain only antibodies.

A single $V_H$ domain antibody capable of binding human PD-1 that can be used in the binding agents of the invention can be produced by a method comprising
   c) immunising a transgenic rodent with an PD-1 antigen wherein said rodent expresses a nucleic acid construct comprising unrearranged human heavy chain V genes and is not capable of making functional endogenous light or heavy chains,
   d) generating a library of sequences comprising $V_H$ domain sequences from said mouse and
   e) isolating sequences comprising $V_H$ domain sequences from said libraries.

Further steps may include identifying a single $V_H$ domain antibody or heavy chain only antibody that binds to human PD-1 but does not block/blocks the interaction of PD-1 and PD-L1 and isolating said antibody, for example by using functional assays as shown in the examples.

Methods for preparing or generating the polypeptides, nucleic acids, host cells, products and compositions described herein using in vitro expression libraries can comprise the steps of:
   a) providing a set, collection or library of nucleic acid sequences encoding amino acid sequences;
   b) screening said set, collection or library for amino acid sequences that can bind to/have affinity for PD-1 and
   c) isolating the amino acid sequence(s) that can bind to/have affinity for PD-1.

In the above method, the set, collection or library of amino acid sequences may be displayed on a phage, phagemid, ribosome or suitable micro-organism (such as yeast), such as to facilitate screening. Suitable methods, techniques and host organisms for displaying and screening (a set, collection or library of) amino acid sequences will be clear to the person skilled in the art (see for example Phage Display of Peptides and Proteins: A Laboratory Manual, Academic Press; 1st edition (Oct. 28, 1996) Brian K. Kay, Jill Winter, John M cCafferty).

Libraries, for example phage libraries, are generated by isolating a cell or tissue expressing an antigen-specific, heavy chain-only antibody, cloning the sequence encoding the VH domain(s) from mRNA derived from the isolated cell or tissue and displaying the encoded protein using a library. The $V_H$ domain(s) can be expressed in bacterial, yeast or other expression systems.

In the various aspects and embodiment of the invention as out herein, the term rodent may relate to a mouse or a rat.

In one embodiment, the rodent is a mouse. The mouse may comprise a non-functional endogenous lambda light chain locus. Thus, the mouse does not make a functional endogenous lambda light chain. In one embodiment, the lambda light chain locus is deleted in part or completely or rendered non-functional through insertion, inversion, a recombination event, gene editing or gene silencing. For example, at least the constant region genes C1, C2 and C3 may be deleted or rendered non-functional through insertion or other modification as described above. In one embodiment, the locus is functionally silenced so that the mouse does not make a functional lambda light chain.

Furthermore, the mouse may comprise a non-functional endogenous kappa light chain locus. Thus, the mouse does not make a functional endogenous kappa light chain. In one embodiment, the kappa light chain locus is deleted in part or completely or rendered non-functional through insertion, inversion, a recombination event, gene editing or gene silencing. In one embodiment, the locus is functionally silenced so that the mouse does not make a functional kappa light chain.

The mouse having functionally-silenced endogenous lambda and kappa L-chain loci may, for example, be made as disclosed in WO 2003/000737, which is hereby incorporated by reference in its entirety.

Furthermore, the mouse may comprise a non-functional endogenous heavy chain locus. Thus, the mouse does not make a functional endogenous heavy chain. In one embodiment, the heavy chain locus is deleted in part or completely or rendered non-functional through insertion, inversion, a recombination event, gene editing or gene silencing. In one embodiment, the locus is functionally silenced so that the mouse does not make a functional heavy chain.

For example, as described in WO 2004/076618 (hereby incorporated by reference in its entirety), all 8 endogenous heavy chain constant region immunoglobulin genes (μ, δ, γ3, γ1, γ2a, γ2b, ε and α) are absent in the mouse, or partially absent to the extent that they are non-functional, or genes δ, γ3, γ1, γ2a, γ2b and ε are absent and the flanking genes μ and α are partially absent to the extent that they are rendered non-functional, or genes μ, δ, γ3, γ1, γ2a, γ2b and ε are absent and α is partially absent to the extent that it is rendered non-functional, or δ, γ3, γ1, γ2a, γ2b, ε and α are absent and μ is partially absent to the extent that it is rendered non-functional. By deletion in part is meant that the endogenous locus gene sequence has been deleted or disrupted, for example by an insertion, to the extent that no functional endogenous gene product is encoded by the locus, i.e., that no functional product is expressed from the locus. In another embodiment, the locus is functionally silenced.

In one embodiment, the mouse comprises a non-functional endogenous heavy chain locus, a non-functional endogenous lambda light chain locus and a non-functional endogenous kappa light chain locus. The mouse therefore does not produce any functional endogenous light or heavy chains. Thus, the mouse is a triple knockout (TKO) mouse.

The transgenic mouse may comprise a vector, for example a Yeast Artificial Chromosome (YAC) for expressing a heterologous, preferably a human, heavy chain locus. YACs are vectors that can be employed for the cloning of very large DNA inserts in yeast. As well as comprising all three cis-acting structural elements essential for behaving like natural yeast chromosomes (an autonomously replicating sequence (ARS), a centromere (CEN) and two telomeres (TEL)), their capacity to accept large DNA inserts enables them to reach the minimum size (150 kb) required for chromosome-like stability and for fidelity of transmission in yeast cells. The construction and use of YACs is well known in the art (e.g., Bruschi, C. V. and Gjuracic, K. Yeast Artificial Chromosomes, Encyclopedia of Life Sciences, 2002 Macmillan Publishers Ltd, Nature Publishing Group).

For example, the YAC may comprise a plethora of unrearranged human $V_H$, D and J genes in combination with mouse immunoglobulin constant region genes lacking $C_H1$ domains, mouse enhancer and regulatory regions. The human $V_H$, D and J genes are human $V_H$, D and J loci and they are unrearranged genes that are fully human. An example of such a YAC is provided in the example section.

Alternative methods known in the art may be used for deletion or inactivation of endogenous mouse or rat immunoglobulin genes and introduction of human $V_H$, D and J genes in combination with mouse immunoglobulin constant region genes lacking $C_H1$ domains, mouse enhancer and regulatory regions.

Transgenic mice can be created according to standard techniques as illustrated in the examples. The two most characterised routes for creating transgenic mice are via pronuclear microinjection of genetic material into freshly fertilised oocytes or via the introduction of stably transfected embryonic stem cells into morula or blastocyst stage embryos. Regardless of how the genetic material is introduced, the manipulated embryos are transferred to pseudopregnant female recipients where pregnancy continues and candidate transgenic pups are born.

The main differences between these broad methods are that ES clones can be screened extensively before their use to create a transgenic animal. In contrast, pronuclear microinjection relies on the genetic material integrating to the host genome after its introduction and, generally speaking, the successful incorporation of the transgene cannot be confirmed until after pups are born.

There are many methods known in the art to both assist with and determine whether successful integration of transgenes occurs. Transgenic animals can be generated by multiple means including random integration of the construct into the genome, site-specific integration, or homologous recombination. There are various tools and techniques that can be used to both drive and select for transgene integration and subsequent modification including the use of drug resistance markers (positive selection), recombinases, recombination-mediated cassette exchange, negative selection techniques, and nucleases to improve the efficiency of recombination. Most of these methods are commonly used in the modification of ES cells. However, some of the techniques may have utility for enhancing transgenesis mediated via pronuclear injection.

Further refinements can be used to give more efficient generation of the transgenic line within the desired background. As described above, in preferred embodiments, the endogenous mouse immunoglobulin expression is silenced to permit sole use of the introduced transgene for the expression of the heavy-chain only repertoire that can be exploited for drug discovery. Genetically-manipulated mice, for example TKO mice that are silenced for all endogenous immunoglobulin loci (mouse heavy chain, mouse kappa chain and mouse lambda chain) can be used as described above. The transfer of any introduced transgene to this TKO background can be achieved via breeding, either conventional or with the inclusion of an IVF step to give efficient scaling of the process. However, it is also possible to include the TKO background during the transgenesis procedure. For example, for microinjection, the oocytes may be derived from TKO donors. Similarly, ES cells from TKO embryos can be derived for use in transgenesis.

Triple knock-out mice into which transgenes have been introduced to express immunoglobulin loci are referred to herein as TKO/Tg.

In one embodiment, the mouse is as described in WO2016/062990.

In another aspect of the present invention, there is provided a pharmaceutical composition comprising a binding agent or composition according to the present invention and optionally a pharmaceutically acceptable carrier. A binding agent of the present invention or the pharmaceutical composition of the invention can be administered by any convenient route, including but not limited to oral, topical, parenteral, sublingual, rectal, vaginal, ocular, intranasal, pulmonary, intradermal, intravitrial, intramuscular, intraperitoneal, intravenous, subcutaneous, intracerebral, transdermal, transmucosal, by inhalation, or topical, particularly to the ears, nose, eyes, or skin or by inhalation.

Parenteral administration includes, for example, intravenous, intramuscular, intraarterial, intraperitoneal, intranasal, rectal, intravesical, intradermal, topical or subcutaneous administration. Preferably, the compositions are administered parenterally.

The pharmaceutically acceptable carrier or vehicle can be particulate, so that the compositions are, for example, in tablet or powder form. The term "carrier" refers to a diluent, adjuvant or excipient, with which a drug antibody conjugate of the present invention is administered. Such pharmaceutical carriers can be liquids, such as water and oils, including those of petroleum, animal, vegetable or synthetic origin, such as peanut oil, soybean oil, mineral oil, sesame oil and the like. The carriers can be saline, gum acacia, gelatin, starch paste, talc, keratin, colloidal silica, urea, and the like. In addition, auxiliary, stabilizing, thickening, lubricating and coloring agents can be used. In one embodiment, when administered to an animal, the single domain antibody of the present invention or compositions and pharmaceutically acceptable carriers are sterile. Water is a preferred carrier when the drug antibody conjugates of the present invention are administered intravenously. Saline solutions and aqueous dextrose and glycerol solutions can also be employed as liquid carriers, particularly for injectable solutions. Suitable pharmaceutical carriers also include excipients such as starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The present compositions, if desired, can also contain minor amounts of wetting or emulsifying agents, or pH buffering agents.

The pharmaceutical composition of the invention can be in the form of a liquid, e.g., a solution, emulsion or suspension. The liquid can be useful for delivery by injection, infusion (e.g., IV infusion) or sub-cutaneously.

When intended for oral administration, the composition is preferably in solid or liquid form, where semi-solid, semi-liquid, suspension and gel forms are included within the forms considered herein as either solid or liquid.

As a solid composition for oral administration, the composition can be formulated into a powder, granule, compressed tablet, pill, capsule, chewing gum, wafer or the like form. Such a solid composition typically contains one or more inert diluents. In addition, one or more of the following can be present: binders such as carboxymethylcellulose, ethyl cellulose, microcrystalline cellulose, or gelatin; excipients such as starch, lactose or dextrins, disintegrating agents such as alginic acid, sodium alginate, corn starch and the like; lubricants such as magnesium stearate; glidants such as colloidal silicon dioxide; sweetening agents such as sucrose or saccharin; a flavoring agent such as peppermint, methyl salicylate or orange flavoring; and a coloring agent. When the composition is in the form of a capsule (e. g. a gelatin capsule), it can contain, in addition to materials of the above type, a liquid carrier such as polyethylene glycol, cyclodextrin or a fatty oil.

The composition can be in the form of a liquid, e. g. an elixir, syrup, solution, emulsion or suspension. The liquid can be useful for oral administration or for delivery by injection. When intended for oral administration, a composition can comprise one or more of a sweetening agent, preservatives, dye/colorant and flavor enhancer. In a composition for administration by injection, one or more of a surfactant, preservative, wetting agent, dispersing agent, suspending agent, buffer, stabilizer and isotonic agent can also be included.

Compositions can take the form of one or more dosage units.

In specific embodiments, it can be desirable to administer the composition locally to the area in need of treatment, or by intravenous injection or infusion.

The amount of the binding agent of the present invention that is effective/active in the treatment of a particular disorder or condition will depend on the nature of the disorder or condition, and can be determined by standard clinical techniques. In addition, in vitro or in vivo assays can optionally be employed to help identify optimal dosage ranges. The precise dose to be employed in the compositions will also depend on the route of administration, and the seriousness of the disease or disorder, and should be decided according to the judgment of the practitioner and each patient's circumstances. Factors like age, body weight, sex, diet, time of administration, rate of excretion, condition of the host, drug combinations, reaction sensitivities and severity of the disease shall be taken into account.

Typically, the amount is at least about 0.01% of a single domain antibody of the present invention by weight of the composition. When intended for oral administration, this amount can be varied to range from about 0.1% to about 80% by weight of the composition. Preferred oral compositions can comprise from about 4% to about 50% of the sdAb of the present invention by weight of the composition.

Preferred compositions of the present invention are prepared so that a parenteral dosage unit contains from about 0.01% to about 2% by weight of the single domain antibody of the present invention.

For administration by injection, the composition can comprise from about typically about 0.1 mg/kg to about 250 mg/kg of the animal's body weight, preferably, between about 0.1 mg/kg and about 20 mg/kg of the animal's body weight, and more preferably about 1 mg/kg to about 10 mg/kg of the animal's body weight. In one embodiment, the composition is administered at a dose of about 1 to 30 mg/kg, e.g., about 5 to 25 mg/kg, about 10 to 20 mg/kg, about 1 to 5 mg/kg, or about 3 mg/kg. The dosing schedule can vary from e.g., once a week to once every 2, 3, or 4 weeks.

The invention provides methods of treating PD-1-mediated diseases or disorders in a mammal, e.g., a human patient, comprising administering an effective amount of a binding agent or pharmaceutical composition of the present invention to a mammal in need thereof. In particular, the invention furthermore relates to a method for the prevention and/or treatment of a disorder selected from cancer, an immune disorder, neurological disease, inflammatory disorder, allergy, transplant rejection, viral infection, immune deficiency, and other immune system-related disorder said method comprising administering, to a subject in need thereof, a pharmaceutically active amount of a binding agent or pharmaceutical composition of the invention.

As used herein, "treat", "treating" or "treatment" means inhibiting or relieving a disease or disorder. For example, treatment can include a postponement of development of the symptoms associated with a disease or disorder, and/or a reduction in the severity of such symptoms that will, or are expected, to develop with said disease. The terms include ameliorating existing symptoms, preventing additional symptoms, and ameliorating or preventing the underlying causes of such symptoms. Thus, the terms denote that a beneficial result is being conferred on at least some of the mammals, e.g., human patients, being treated. Many medical treatments are effective for some, but not all, patients that undergo the treatment.

The term "subject" or "patient" refers to an animal which is the object of treatment, observation, or experiment. A subject includes, but is not limited to, a mammal, including, but not limited to, a human or a non-human mammal, such as a non-human primate, murine, bovine, equine, canine, ovine, or feline subject.

As used herein, the term "effective amount" means an amount of an anti-PD-1 antibody, that when administered alone or in combination with an additional therapeutic agent to a cell, tissue, or subject, is effective to achieve the desired therapeutic or prophylactic effect under the conditions of administration.

The invention also relates to a binding agent or pharmaceutical composition of the invention for use in the treatment or prevention of a disease.

In another aspect, the invention relates to a binding agent or pharmaceutical composition of the invention for use in the treatment or prevention of cancer, an immune disorder, neurological disease, inflammatory disorder, allergy, transplant rejection, viral infection, immune deficiency, and other immune system-related disorder.

In another aspect, the invention relates to the use of a binding agent or pharmaceutical composition of the invention in the treatment or prevention of a disease.

In another aspect, the invention relates to the use of a binding agent or pharmaceutical composition of the invention in the manufacture of a medicament for the treatment or prevention of cancer, an immune disorder, neurological disease, inflammatory disorder, allergy, transplant rejection, viral infection, immune deficiency, and other immune system-related disorder.

The cancer can be selected from a solid or non-solid tumor. For example, the cancer may be selected from bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, breast cancer, brain cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the thyroid gland, cancer of the parathyroid gland, cancer of the adrenal gland, kidney cancer, sarcoma of soft tissue, cancer of the urethra, cancer of the bladder, renal cancer, lung cancer, non-small cell lung cancer, thymoma, urothelial carcinoma leukemia, prostate cancer, mesothelioma, adrenocortical carcinoma, lymphomas, such as such as Hodgkin's disease, non-Hodgkin's, gastric cancer, and multiple myelomas.

In one embodiment, the tumor is a solid tumor. Examples of solid tumors which may be accordingly treated include breast carcinoma, lung carcinoma, colorectal carcinoma, pancreatic carcinoma, glioma and lymphoma. Some examples of such tumors include epidermoid tumors, squamous tumors, such as head and neck tumors, colorectal tumors, prostate tumors, breast tumors, lung tumors, including small cell and non-small cell lung tumors, pancreatic tumors, thyroid tumors, ovarian tumors, and liver tumors. Other examples include Kaposi's sarcoma, CNS, neoplasms, neuroblastomas, capillary hemangioblastomas, meningiomas and cerebral metastases, melanoma, gastrointestinal and renal carcinomas and sarcomas, rhabdomyosarcoma, glioblastoma, preferably glioblastoma multiforme, and leiomyosarcoma. Examples of vascularized skin cancers for which the antagonists of this invention are effective include squamous cell carcinoma, basal cell carcinoma and skin cancers that can be treated by suppressing the growth of malignant keratinocytes, such as human malignant keratinocytes.

In one embodiment, the tumor is a non-solid tumor. Examples of non-solid tumors include leukemia, multiple myeloma and lymphoma.

In one aspect, the cancer is identified as a PD-L1 positive cancer. In one aspect, the cancer is locally advanced unresectable, metastatic, or recurrent cancer.

Preferred cancers whose growth may be inhibited using the binding agent include cancers typically responsive to immunotherapy. Non-limiting examples of preferred cancers for treatment include melanoma (e.g., metastatic malignant melanoma), renal cancer (e.g. clear cell carcinoma), prostate cancer (e.g. hormone refractory prostate adenocarcinoma), breast cancer, colon cancer and lung cancer (e.g. non-small cell lung cancer).

In one embodiment, the cancer has progressed after another treatment, for example chemotherapy.

The binding agents and pharmaceutical compositions of the present invention are particularly useful for the treatment of cancers that are associated with cells (e.g., exhausted T cells, B cells, monocytes, etc.) that express abnormally high levels of PD-1. Other preferred cancers include those characterized by elevated expression of PD-1 and/or its ligands PD-L1 and/or PD-L2. In one embodiment, the cancer is selected from a cancer that has high levels of cancer-associated genetic mutations and/or high levels of expression of tumour antigens. In another embodiment, the cancer is selected from a cancer known to be immunogenic or that is able to become immunogenic upon treatment with other cancer therapies.

The immune disorder can be selected from graft vs. host disease, arthritis, such as rheumatoid arthritis, alopecia areata, ankylosing spondylitis, antiphospholipid syndrome, autoimmune Addison's disease, autoimmune diseases of the adrenal gland, autoimmune hemolytic anemia, autoimmune hepatitis, autoimmune oophoritis and orchitis, autoimmune thrombocytopenia, Behcet's disease, bullous pemphigoid, cardiomyopathy, celiac sprue-dermatitis, chronic fatigue immune dysfunction syndrome (CFIDS), chronic inflammatory demyelinating polyneuropathy, Churg-Strauss syndrome, cicatrical pemphigoid, CREST syndrome, cold agglutinin disease, Crohn's disease, discoid lupus, essential mixed cryoglobulinemia, fibromyalgia-fibromyositis, glomerulonephritis, Graves' disease, Guillain-Barre, Hashimoto's thyroiditis, idiopathic pulmonary fibrosis, idiopathic thrombocytopenia purpura (ITP), IgA neuropathy, juvenile arthritis, lichen planus, lupus erthematosus, Meniere's disease, mixed connective tissue disease, multiple sclerosis, Neuromyelitis optica (NMO), type 1 or immune-mediated diabetes mellitus, myasthenia gravis, pemphigus vulgaris, pernicious anemia, polyarteritis nodosa, polychrondritis, polyglandular syndromes, polymyalgia rheumatica, polymyositis and dermatomyositis, primary agammaglobulinemia, primary biliary cirrhosis, psoriasis, psoriatic arthritis, Raynauld's phenomenon, Reiter's syndrome, rheumatoid arthritis, sarcoidosis, scleroderma, Sjogren's syndrome, stiff-man syndrome, systemic lupus erythematosus, lupus erythematosus, takayasu arteritis, temporal arteristis/giant cell arteritis, transverse myelitis, ulcerative colitis, uveitis, vasculitides such as dermatitis herpetiformis vasculitis, vitiligo, and Wegener's granulomatosis.

The neurological disease can be selected from Alzheimer's disease, epilepsy, Parkinson's disease, dementia, multiple sclerosis, peripheral neuropathy or post-herpetic neuralgia.

The binding agent or pharmaceutical composition of the invention may be administered as the sole active ingredient or in combination with one or more other therapeutic agent. A therapeutic agent is a compound or molecule which is useful in the treatment of a disease. Examples of therapeutic agents include antibodies, antibody fragments, drugs, toxins, nucleases, hormones, immunomodulators, pro-apoptotic agents, anti-angiogenic agents, boron compounds, photoactive agents or dyes and radioisotopes. An antibody molecule includes a full antibody or fragment thereof (e.g., a Fab, F(ab')2, Fv, a single chain Fv fragment (scFv) or a single domain antibody, for example a $V_H$ domain) or antibody mimetic protein.

In one embodiment, the binding agent is used in combination with an existing therapy or therapeutic agent, for example an anti-cancer therapy. Thus, in another aspect, the invention also relates to a combination therapy comprising administration of a single domain antibody or pharmaceutical composition of the invention and an anti-cancer therapy. The anti-cancer therapy may include a therapeutic agent or radiation therapy and includes gene therapy, viral therapy, RNA therapy bone marrow transplantation, nanotherapy, targeted anti-cancer therapies or oncolytic drugs. Examples of other therapeutic agents include other checkpoint inhibitors, antineoplastic agents, immunogenic agents, attenuated cancerous cells, tumor antigens, antigen presenting cells such as dendritic cells pulsed with tumor-derived antigen or nucleic acids, immune stimulating cytokines (e.g., IL-2, IFNa2, GM-CSF), targeted small molecules and biological molecules (such as components of signal transduction pathways, e.g. modulators of tyrosine kinases and inhibitors of receptor tyrosine kinases, and agents that bind to tumor-specific antigens, including EGFR antagonists), an anti-inflammatory agent, a cytotoxic agent, a radiotoxic agent, or an immunosuppressive agent and cells transfected with a gene encoding an immune stimulating cytokine (e.g., GM-CSF), chemotherapy. Binding agents and pharmaceutical compositions of the invention can also be combined with surgery.

In one embodiment, the binding agent or pharmaceutical composition of the invention is administered together with an immunomodulator, a checkpoint modulator, an agent involved in T-cell activation, a tumour microenvironment modifier (TME) or a tumour-specific target. For example, the immunomodulator can be an inhibitor of an immune checkpoint molecule selected from an inhibitor of one or more of PD-1, PD-L1, PD-L2, CTLA-4, TIM-3, LAG-3, CEACAM, VISTA, BTLA, TIGIT, LAIR1, CD160, 2B4 or TGFR beta. In another embodiment, the immunomodulator can be an activator of a costimulatory molecule selected from an agonist of one or more of OX40, OX40L, CD2, CD27, CDS, ICAM-1, LFA-1 (CD11a/CD18), ICOS (CD278), 4-1BB (CD137), GITR, CD30, CD40, BAFFR, HVEM, CD7, LIGHT, NKG2C, SLAMF7, NKp80, CD160, B7-H3 or CD83 ligand, CD3, CD8, CD28, CD4 or ICAM-1.

In one embodiment, the PD-1 inhibitor is an anti-PD-1 antibody chosen from Nivolumab®, Pembrolizumab® or Pidilizumab®.

In one embodiment, the composition is administered concurrently with a chemotherapeutic agent or with radiation therapy. In another specific embodiment, the chemotherapeutic agent or radiation therapy is administered prior or subsequent to administration of the composition of the present invention, preferably at least an hour, five hours, 12 hours, a day, a week, a month, more preferably several months (e. g. up to three months), prior or subsequent to administration of composition of the present invention.

In some embodiments, the binding agent may be administered with two or more therapeutic agents. In some embodiments, the binding agents of the invention may be administered with two or more therapeutic agents.

The binding agent or pharmaceutical composition may be administered at the same time or at a different time as the other therapy or therapeutic compound or therapy, e.g., simultaneously, separately or sequentially.

In another aspect, the invention relates to an immunoconjugate comprising a binding agent of the invention conjugated to at least one therapeutic and/or diagnostic agent.

In another aspect, the invention relates to a method for increasing T-cell effector function by administration of a multiparatopic binding agent as described herein.

In another aspect, the invention relates to a method for rescuing T-cell from exhaustion by administration of a multiparatopic binding agent as described herein.

In another aspect, the invention provides a kit for the treatment or prevention of a disease or an immune response and/or for detecting PD-1 for diagnosis, prognosis or monitoring disease comprising a binding agent of the invention. Such a kit may contain other components, packaging, instructions, or material to aid in the detection of PD-1 protein. The kit may include a labeled binding agent of the invention as described above and one or more compounds for detecting the label.

The invention in another aspect provides a binding agent of the invention packaged in lyophilized form, or packaged in an aqueous medium.

The invention also relates to a binding agent as described herein with reference to the figures and examples.

In another aspect, a binding agent of the invention is used for non-therapeutic purposes, such as diagnostic tests and assays. A method for detecting the presence of human PD-1 in a test sample comprises contacting said sample with a binding agent according to the invention and at least one detectable label and detecting binding of said binding agent to human PD-1.

In one embodiment, the invention relates to a method of diagnosing a PD-1-mediated adaptive immune resistance in a patient who has cancer. The method comprises contacting a sample with a compound disclosed herein that has been labelled with a detectable moiety; and detecting expression of PD-1 on immune cells, e.g., CD8+ T cells; B cells; and macrophages. The sample may be tumour tissue.

Modifications of antibodies for diagnostic purposes are well known in the art. For example, antibodies may be modified with a ligand group such as biotin, or a detectable marker group such as a fluorescent group, a radioisotope, or an enzyme. Compounds of the invention can be labelled using conventional techniques. Suitable detectable labels include but are not limited to fluorophores, chromophores, radioactive atoms, electron-dense reagents, enzymes, and ligands having specific binding partners.

Unless otherwise defined herein, scientific and technical terms used in connection with the present disclosure shall have the meanings that are commonly understood by those of ordinary skill in the art. While the foregoing disclosure provides a general description of the subject matter encompassed within the scope of the present invention, including methods, as well as the best mode thereof, of making and using this invention, the following examples are provided to further enable those skilled in the art to practice this invention and to provide a complete written description thereof. However, those skilled in the art will appreciate that the specifics of these examples should not be read as limiting on the invention, the scope of which should be apprehended from the claims and equivalents thereof appended to this disclosure. Various further aspects and embodiments of the present invention will be apparent to those skilled in the art in view of the present disclosure.

All documents mentioned in this specification are incorporated herein by reference in their entirety, including references to gene accession numbers and references to patent publications.

"and/or" where used herein is to be taken as specific disclosure of each of the two specified features or components with or without the other. For example "A and/or B" is to be taken as specific disclosure of each of (i) A, (ii) B and (iii) A and B, just as if each is set out individually herein. Unless context dictates otherwise, the descriptions and definitions of the features set out above are not limited to any particular aspect or embodiment of the invention and apply equally to all aspects and embodiments which are described.

The invention is further described in the non-limiting examples.

EXAMPLES

Example 1

Construction of Tg/TKO Mice

Mice carrying a human heavy-chain antibody transgenic locus in germline configuration within a background that is silenced for endogenous heavy and light chain antibody expression (triple knock-out, or TKO) were created as previously described (WO2004/076618, WO2003/000737, Ren et al., Genomics, 84, 686, 2004; Zou et al., J. Immunol., 170, 1354, 2003 and WO2016/062990). Briefly, transgenic mice were derived following pronuclear microinjection of freshly fertilised oocytes with a yeast artificial chromosome (YAC) comprising a plethora of human $V_H$, D and J genes in combination with mouse immunoglobulin constant region genes lacking $C_H1$ domains, mouse enhancer and regulatory regions. Yeast artificial chromosomes (YACs) are vectors that can be employed for the cloning of very large DNA inserts in yeast. As well as comprising all three cis-acting structural elements essential for behaving like natural yeast chromosomes (an autonomously replicating sequence (ARS), a centromere (CEN) and two telomeres (TEL)), their capacity to accept large DNA inserts enables them to reach the minimum size (150 kb) required for chromosome-like stability and for fidelity of transmission in yeast cells. The construction and use of YACs is well known in the art (e.g., Bruschi, C. V. and Gjuracic, K. Yeast Artificial Chromosomes, Encyclopedia of Life Sciences, 2002, Macmillan Publishers Ltd., Nature Publishing Group/www.els.net).

The YAC used comprised multiple human heavy chain V genes, multiple human heavy chain D and J genes, a murine $C_H1$ gene and a murine 3' enhancer gene. It lacks the $C_H1$ exon.

The transgenic founder mice were back crossed with animals that lacked endogenous immunoglobulin expression to create the Tg/TKO lines used in the immunisation studies described.

Example 2

Antigen for Immunisation

The immunisations used recombinant human PD-1 Fc chimera purchased from R&D, catalogue number 1086-PD, lot number FVQ081502B or FVQ081503A.

Recombinant human PD-1-TetTox protein was used in another separate immunisation. This is based on residues 1-167 of human PD-1 and comprises at the N terminus the tet toxin linked to PD-1 via a polylinker. Also included is an N-terminal His tag as well as leader sequence and restriction site for proteolytic cleavage.

CHO cell lines expressing human PD-1 on the surface were made in house.

Example 3

Immunisation Protocol

Tg/TKO mice aged 8-12 weeks of age each received an initial prime dose of either 50 ug or 10 ug of recombinant purified human PD-1-Fc protein emulsified in Complete Freund's Adjuvant and delivered subcutaneously, followed by three boosts of 10 μg of the recombinant protein, emulsified in Incomplete Freund's Adjuvant, also administered subcutaneously, given at various intervals following the initial priming. A final dose of 10 μg or 20 ug recombinant purified human PD-1 protein antigen was administered intraperitoneally, in phosphate buffered saline, in the absence of adjuvant.

A separate cohort of Tg/TKO mice aged 8-12 weeks of age each received an initial prime dose of 10 ug of recombinant purified human PD1-TetTox protein emulsified in Complete Freund's Adjuvant and delivered subcutaneously, followed by three boosts of 10 μg emulsified in Incomplete Freund's Adjuvant, also administered subcutaneously, given at various intervals following the initial priming. A final dose of 10 μg recombinant purified human PD-1-Tettox protein antigen was administered intraperitoneally, in phosphate buffered saline, in the absence of adjuvant.

Another cohort of animals was primed with 50 ug purified human PD-1-Fc protein as above, followed by three boosts of 10 million cells expressing human PD1 at high levels on the surface. The boosts were given without adjuvant, two of them sub cutaneously and the third intraperitoneally. A final dose of 10 μg recombinant purified human PD-1-Fc protein was administered intraperitoneally, in phosphate buffered saline, in the absence of adjuvant.

Example 4

Serum ELISA

Serum was collected from mice before and after immunisation, and checked by ELISA for the presence of serum PD-1/Fc reactive heavy chain antibodies in response to immunisation with PD1 antigen. Nunc Maxisorp plates (Nunc cat. no. 443404) were coated overnight at 4° C. with 50 μl/well of either a 1 μg/ml recombinant huPD-1Fc solution in PBS (R&D 1086-PD) or of hPD-1 HIS in PBS R&D (8986-PD or 9047-PD). Plates were washed using PBS (prepared from PBS tablets, Oxoid cat. no. BR0014G) supplemented with 0.05% (v/v) Tween® 20 (Sigma P1379), followed by washes with PBS without added Tween 20. To block non-specific protein interactions, a solution of 3% (w/v) skimmed milk powder (Marvel®) in PBS was added to the wells and the plate was incubated for at least one hour at room temperature, then discarded.

Whole blood samples were centrifuged at 13000 rpm for 5 mins to separate blood from serum. Dilutions of serum were prepared in 3% Marvel™/PBS in polypropylene tubes or plates, pre-incubated for at least one hour at room temperature then transferred to the blocked ELISA plate and incubated for at least one hour. Unbound protein was removed by repetitive washing with PBS/Tween 20 followed by PBS. A 1:10,000 solution of biotin-conjugated, goat anti-mouse IgG, Fcgamma subclass 1 specific antibody (Jackson cat. no.115-065-205), prepared in PBS/3% Marvel was added to each well and incubated at room temperature for at least one hour. Unbound detection antibody was removed by repeated washing using PBS/Tween 20 and PBS. Neutravidin-HRP solution (Pierce cat. no. 31030) in 3% Marvel/PBS was added to the ELISA plates and allowed to bind for 30 minutes, then washed as above. The ELISA was developed using TMB substrate (Sigma cat. no. T0440) and the reaction was stopped after 7 minutes by the addition of 50 ul 0.5M $H_2SO_4$ solution (Sigma cat. no. 320501). Absorbances were read at 450 nm with the BMG Pherastar.

Mice were checked by ELISA for the presence of antibody in serum. All mice showed a robust immune response.

Example 5

Generation of Libraries from Immunised Mice

Tissue Collection and Homogenisation

Generation of libraries from immunised mice described above followed standard protocols of library generation as summarised below. Total spleen, inguinal and brachial lymph nodes were and processed according to standard protocols.

RNA Extraction and RT-PCR

Spleen: 400 μl supernatant was used for preparation of total RNA. RNA was extracted using Qiagen RNeasy® kit (cat. no. 74104) following the manufacturer's protocol.

Lymph nodes: prepared by essentially the same process on the Kingfisher.

$V_H$ sequences were mined from the RNA samples using Superscript III RT-PCR high-fidelity kit (Invitrogen cat. no. 12574-035) according to the manufacturer's protocol. For each spleen and LN RNA sample, RT-PCR reactions were performed using a single $J_H$ primer in combination with primers for $V_H1$, $V_H2$, $V_H3$, $V_H4$ or $V_H6$ families.

RT-PCR products were pooled so that $V_H1$ products from lymph nodes 1-4 and spleen were combined. Amplified material was purified using the GeneJet™ purification kit (cat #K0702) according to the manufacturer's protocol, eluting in 50 ul water.

Cloning Into Phagemid Vector

The phagemid vector, pUCG3, was employed in these studies. A conventional PCR-based method was used to construct the VH phagemid libraries from the amplified $V_H$ sequences. In short, he following procedure was used:

A linearised version of pUCG3 was created using PCR. Vector PCR product (3152 bp) was gel purified using Fermentas GeneJet Gel purification kit (cat. no. K0691), according to the manufacturer's instructions. Purified $V_H$ RT-PCR products were used to prime a PCR reaction from the linearised pUCG3 resulting in a heterogeneous population of $V_H$ cloned into pUCG3.

PCR products were analysed on a 1% (w/v) agarose gel

Generation of Phagemid Library $V_H$/phagemid PCR products were pooled by animal-of-origin and purified using Fermentas PCR purification kit (cat. no. K0702) according to the manufacturer's instructions. The final elution was in 22 μl $H_2O$.

Eluted DNA was used to transform TG1 E. coli (Lucigen, cat. no. 60502-2) by electroporation using the Bio-Rad GenePulser Xcell pulsed at 2500V, 25 uF, 200 W. Electroporated cells were pooled.

A 10-fold dilution series of the transformations was plated on 2×TY agar petri plates with 2% (w/v) glucose and 100 μg/ml ampicillin. Resulting colonies on these dishes were used to estimate library size. The remainder of the transformation was plated on large format 2×TY agar Bioassay dishes supplemented with 2% (w/v) glucose and 100 μg/ml ampicillin. All agar plates were incubated overnight at 30° C.

Libraries were harvested by adding 10 ml of 2×TY broth to the large format bioassay dishes. Bacterial colonies were gently scraped and OD600 recorded. Aliquots were stored at −80° C. in cryovials after addition of an equal volume of 50% (v/v) glycerol solution or used directly in a phage selection process Example 6

Selection Strategies for Isolation of PD-1 Binding $V_H$ Isolation and Optimisation Preparation of library phage stocks and phage display selections were performed according to published methods (Antibody Engineering, edited by Benny Lo, chapter 8, p 161-176, 2004). In most cases, phage display combined with a panning approach was used to isolate binding $V_H$ domains. However, a variety of different selection methods are well described in the art, including soluble selection and selections performed under stress (e.g., heat).

Where optimisation was carried out, standard methods were employed for optimisation, for example to increase $V_H$ affinity for antigen, the choice and combination of which was driven by the starting potency of the $V_H$ in question. Several of the optimisation strategies used are already described in the art and include:

a) shuffling (Antibody Engineering, Edited by Benny Lo, chapter 19, p 327-343, 2004);
b) Targeted randomisation of CDR3 regions using randomised oligonucleotides and phage display technology (Main et al., J Pharmacol Exp Ther. 2006 December; 319(3): 1395-404.);
c) Ribosome display.

Example 7

Screening of Periplasmic Extracts for Binding to CHO Human PD1 Cells and Inhibition of PD-L1 Binding PD-1

Following selections of the libraries, specific $V_H$ that bound to CHO cells expressing human PD-1 and inhibited the interaction between recombinant human PD1 protein and recombinant human PD-L1 protein were identified by single point screening of bacterial periplasmic extracts. Specific $V_H$ that bound to CHO cells expressing human PD-1 and either partially inhibited or did not inhibit the interaction between recombinant human PD-1 protein and recombinant human PD-L1 protein were identified by single point screening of bacterial periplasmic extracts.

Small-scale bacterial periplasmic extracts were prepared from 1 ml cultures, grown in deep well plates. Starter cultures were used to inoculate 96-well deep well plates (Fisher, cat. no. MPA-600-030X) containing 2×TY broth (Melford cat. no. M2130), supplemented with 0.1% (w/v) glucose and 100 µg/ml ampicillin at 37° C. with 250 rpm shaking. When $OD_{600}$ had reached 0.6-1, $V_H$ production was induced by adding 100 µl of 2×TY, supplemented with IPTG (final concentration 0.5 mM) and ampicillin and the cultures were grown overnight at 30° C. with shaking at 220 rpm. *E. coli* were pelleted by centrifugation at 3200 rpm for 10 mins and supernatants discarded. Cell pellets were resuspended in 120 µl of ice cold extraction buffer (50 mM MOPs, 0.5 mM EDTA, 0.5M Sucrose), then 180 µl of 1:5 diluted ice cold extraction buffer added. Cells were incubated on ice for 30 minutes and then centrifuged at 4500 rpm for 15 mins at 4° C. Supernatants were transferred to polypropylene plates for testing in assays.

Binding of His-tagged $V_H$ in the supernatants to CHO cell expressed human PD-1 was assessed using Fluorescence Microvolume Assay Technology (FMAT), a fluorescence-based platform that detects fluorescence localized to beads or cells settled at the bottom of microwells (Dietz et al., *Cytometry* 23:177-186 (1996), Miraglia et al., *J. Biomol. Screening* 4:193-204 (1999). A CHO TREX human PD1 cell line was generated in-house using full-length human PD-1 sequence by standard procedures. All reagents were prepared in FMAT assay buffer (pH 7.4) containing PBS, 0.1% Bovine Serum Albumin, 0.01% Sodium Azide. Peripreps were transferred into 384 well black clear-bottomed assay plates (Costar cat. no. 3655) and incubated for a minimum of 2 hours at room temperature with 1.5 nM Anti-His (Millipore cat. no. 05-949)/3 nM Goat Anti-Mouse Alexa Fluor-488 (Jackson Immunolabs cat. no. 115-545-071) and 2000 CHO human PD1 cells prestained with DRAQ5 (Thermo Scientific cat. no. 62251). Plates were read in the FL2 (502 nm-537 nm) and FL5 (677-800 nm) channels on the TTP Mirrorball plate reader following excitation at 488 nm and 640 nm. Data was gated on FL5 perimeter and peak intensity and the FL2 median mean fluorescence intensity of the gated data used for determination of $V_H$ binding.

In parallel to the CHO PD-1 binding assay periplasmic extracts were tested for their ability to inhibit the interaction of PD-L1 protein with PD-1 protein by single point screening in an HTRF inhibition assay. All samples and reagents were prepared in HTRF assay buffer containing PBS, 0.1% (w/v) BSA and 0.4M Potassium Fluoride. Periplasmic extracts were incubated with 25 nM strep tagged PD-L1 (Acro Biosystems cat no. PD1-H5282), 1.5 nM Anti human-Fc Cryptate PAb (Cisbio cat. no. 61HFCKLB), 10 nM StrepMAB-Oyster 645 conjugate in black 384-shallow-well plates (Costar cat. no. 3676) for a minimum of 3 hours at room temperature. Total binding controls containing periplasmic extract sample buffer and non-specific binding controls containing excess untagged competitor were set up on each plate for data normalisation. Time-resolved fluorescent emission at 620 nm and 665 nm was measured following excitation at 337 nm on the BMG PHERAstar plate reader. Data was expressed as a % of the total binding control (% control) after subtraction of the background signal determined from the non-specific binding control wells.

Families of $V_H$ were identified that bound to the CHO human PD-1 cells with FL2 fluorescence >1000 and that fully inhibited PD-1 binding to PDL-1. $V_H$ were identified that bound to the CHO human PD-1 cells with FL2 fluorescence >1000 and showed partial or no inhibition of PD-1 binding to PD-L1.

Example 8

Sequencing

Each individual $V_H$ clone as identified above was sequenced from the phagemid and grouped based on $V_H$ germline and CDR3 amino acid similarity. Representative clones were further characterised.

Further clones were also generated by sequence optimisation of single domain antibodies numbered 1.1a and 1.1b. Standard methods were used for optimisation.

$V_H$ single domain antibodies numbered 1.xa as shown in table 1 (wherein x is a number, e.g. 1.1a etc) bind to PD-1, but do not block ligand binding. 1.1a to 1.21a were isolated as above. Single domain antibodies 1.19a-1.50a are sequence optimised single domain antibodies of single domain antibody 1.1a. Single domain antibodies 1.51a to 1.61a were isolated separately as above and grouped into a single family. 1.62a to 1.03a are sequence optimised single domain antibody of single domain antibody 1.41a.

$V_H$ single domain antibodies numbered 1.xb as shown in table 2 (wherein x is a number e.g. 1.1b etc) bind to PD-1, but block ligand binding 1.1b to 1.73b were isolated as above. Single domain antibody 1.57b is a sequence optimised variant of single domain antibody 1.1b. Single domain antibodies 1.62b-1.115b are sequence optimised variants of 1.b or 1.57b.

Example 9

Preparation and Characterisation of Purified $V_H$ a) Preparation of Purified $V_H$ Purified $V_H$ were obtained by using the $V_H$ C-terminal 6×HIS tag for nickel-agarose affinity chromatographic purification of the periplasmic extracts. A starter culture of each $V_H$ was grown overnight in 2×TY media (2×TY broth (Melford cat. no. M2103) supplemented with 2% (w/v) glucose+100 µg/ml ampicillin at 30° C. with 250 rpm shaking. This overnight culture was then used to inoculate 50 ml-200 ml 2×TY media and incubated at 37° C. with 250 rpm shaking for approximately 6-8 hours (until $OD_{600}$=0.6-1.0). Cultures were centrifuged at 3200 rpm for 10 mins and the cell pellets resuspended in fresh 2×TY broth containing 100 µg/ml ampicillin+1 mM IPTG. Shake flasks were incubated overnight at 30° C. and 250 rpm. Cultures were again centrifuged at 3200 rpm for 10 mins and supernatants discarded. Cell pellets were resuspended in ice cold extraction buffer (20% (w/v) sucrose, 1 mM EDTA, 50 mM Tris-HCl pH 8.0 or 50 mM MOPS) by gently pipetting then diluted further with 1:5 diluted ice cold extraction buffer. Cells were incubated on ice for 30 minutes then centrifuged at 4500 rpm for 15 mins at 4° C. Supernatants were transferred to tubes containing imidazole (Sigma cat. no. 12399—final concentration 10 mM) and pre-equilibrated nickel agarose beads (Qiagen, Ni-NTA 50% soln, cat. no. 30210). $V_H$ binding was allowed to proceed for 2 hours at 4°

C. with gentle shaking. The beads were transferred to a polyprep column (BioRad cat. no. 731-1550) and the supernatant discarded by gravity flow. Columns were washed 3 times with PBS+0.05% Tween® followed by 3 washes with 5 ml of PBS/20 mM Imidazole. $V_H$ were eluted from the columns using PBS/250 mM imidazole. The imidazole was removed from the purified $V_H$ preparations by buffer exchange with NAP-5 columns (GE Healthcare, 17-0853-01) and elution with PBS. Yields of purified $V_H$ were estimated spectrophotometrically and purity was assessed using SDS PAGE.

Alternatively $V_H$ were purified from the supernatants of W3110 E. coli with pJExpress vector. For this procedure up to 400 ml cultures were grown at 37° C. with 250 rpm shaking in TB media before being induced overnight with 1 mM IPTG overnight. The resulting supernatants were harvested and $V_H$ purified on AKTA Pure using a Ni-Sepharose excel column (HiScale 16, GE Healthcare). Yields of purified $V_H$ were estimated spectrophotometrically and purity was assessed using SDS PAGE.

b) Multivalent Constructs

Multivalent constructs described herein were generated by linking isolated $V_H$ nucleic acid sequences using a peptide linker $(G4S)_x$ wherein X is 2, 4, 6 or 9 and proteins were expressed. The techniques used were based on standard molecular biology techniques. In particular, a blocking Humabody® $V_H$ nucleic acid sequence was linked to a binding (non-blocking) Humabody® $V_H$ nucleic acid sequence.

Constructs were also made and expressed where such binding agents were linked to a half life extending Humabody® $V_H$ nucleic acid sequence (a $V_H$ that binds to MSA, termed MSA binder herein). Exemplary linker sequences used for these constructs are shown below in table 4.

Constructs made and tested include: 1.1b-2GS-1.1a, 1.1b-4GS-1.1a, 1.1b-6GS-1.1a, 1.57b-4GS-1.1a, 1.57b-4GS-1.1a-4GS-MSA binder, 1.57-4GS-MSA binder-4GS-1.1a, 1.92b-4GS-1.51a, 1.92b-4GS-1.62a SEQ ID NO. 1114), 1.92b-4GS-1.39a (SEQ ID NO. 1112), 1.92b-4GS-1.99a, 1.77b-4GS-1.21a (SEQ ID NO. 1116), 1.77b-1GS-1.21a (SEQ ID NO. 1118) and 1.77b-2GS-1.21a (SEQ ID NO. 1120).

TABLE 4

| Linker | Peptide sequence | Nucleic acid sequence |
|---|---|---|
| 2GS | GGGGSGGGGS SEQ ID No. 1103 | GGAGGTGGAGGTTCAGGTGGAGGTGGTAGT SEQ ID No. 1104 |
| 4GS | GGGGSGGGGSGG GGSGGGGS SEQ ID No. 1105 | GGAGGTGGAGGTTCAGGAGGTGGTGGTTCT GGTGGTGGCGGTTCAGGTGGAGGTGGTAGT SEQ ID No. 1106 |
| 6GS | GGGGSGGGGSGG GGSGGGGSGGGG SGGGGS SEQ ID No. 1107 | GGTGGTGGCGGTTCAGGCGGAGGTGGCTCT GGAGGTGGAGGTTCAGGAGGTGGTGGTTCT GGCGGCGGTGGATCGGGTGGAGGTGGTAGT SEQ ID No. 1108 |
| 9GS | GGGGSGGGGSGG GGSGGGGSGGGG SGGGGSGGGGSG GGGSGGGGS SEQ ID No. 1109 | GGAGGTGGAGGTTCAGGAGGTGGTGGTTCT GGTGGTGGCGGTTCAGGTGGAGGTGGTAGT GGAAGGTGGTTCTGGCGGAGGAGGATCG GGTGGAGGTGGCTCAGGTGGTGGAGGTAGT GGAGGCGGTGGCAGC SEQ ID No. 1110 | c) Inhibition of Human PD-L1 and PD-L2 Binding to Recombinant Human PD-1

Purified $V_H$ were serially diluted in HTRF assay buffer and tested in the HTRF PD-1:PDL-1 Inhibition assay as described above. For the PDL-2 inhibition assay, recombinant human PD-1 protein was labelled with Europium Trisbipyridine Cryptate (Cisbio cat no. 62EUSPEA) according to the manufacturer's protocol and PDL-2Fc (Acro Biosystems cat no. PD2-H882R) was biotinylated according to EZ-link kit protocol (Thermo 21327) Serial dilutions of $V_H$ were incubated with 10 nM Streptavidin AlexaFluor-647 (Life Technologies cat no. S32357), 3 nM biotinylated PD-L2-Fc and Europium Cryptate labelled PD-1-Fc (167-fold dilution) in a 10 µl assay volume for a minimum of 3 hours at room temperature. FIG. 1a shows example data using single domain antibodies of family b in the PD-L2 assay. FIGS. 1b and c show example data using single domain antibodies of family a in the PD-L1 and PD-L2 assays respectively.

d) Epitope Competition Assays

Neutralising single domain antibodies that belong to the family of single domain antibodies as shown in table 1, including optimised family members, $V_H$ were initially identified by testing of bacterial periplasmic extracts for their ability to compete with the binding of the parental clone 1.1b or 1.57b to CHO human PD1 cells in an FMAT epitope competition assay. Also, clones of table 1, i.e. binding $V_H$ but not blocking ligand binding were tested in an FMAT epitope competition assay.

$V_H$ sequence was amplified by PCR and sub-cloned into a vector enabling expression with a C terminally fused Strep tag. TG1 bacterial cultures transformed with the expression vector were cultured, periplasmic extracts prepared using extraction buffer (20% w/v sucrose, 1 mM EDTA, 50 mM Tris-HCl pH8.0) then Strep-tagged $V_H$ purified from the periplasm using Strep-Tactin affinity resin (Qiagen 30002).

For the epitope competition assay reagents were prepared in FMAT assay buffer. Bacterial periplasmic extracts, buffer (total binding controls) or excess His tagged $V_H$ competitor (non-specific binding control) were incubated with 0.3 nM 1.1b-Strep tagged protein or 1 nM 1.57b-Strep tagged protein, 1.5 nM Strep-Tag® II monoclonal antibody (Millipore 71590), 2.5 nM Goat anti mouse Fc-Alexa Fluor 488 and 2000 CHO human PD1 DRAQ5 stained cells per well in a 384 well black clear-bottomed assay plate. In another assay, serially diluted His tagged $V_H$, buffer (total binding controls) or excess His tagged $V_H$ competitor (non-specific binding control) were incubated with 0.5 nM 1.1a-Strep tagged protein or 1 nM 1.57b-Strep tagged protein, 1.5 nM Strep-Tag® II monoclonal antibody (Millipore 71590), 2.5 nM Goat anti mouse Fc-Alexa Fluor 488 and 2000 CHO human PD1 DRAQ5 stained cells per well in a 384 well black clear-bottomed assay plate.

1.1a did not cross compete with 1.57b-Strep tagged protein for binding to the cells. 1.1b and 1.57b did not cross compete with 1.1a-Strep tagged protein and appeared to enhance binding in the assay. This is shown in FIG. 2. The results demonstrate that single domain antibodies of Family a bind to a different epitope than single domain antibodies of Family b.

Multivalent molecules 1.92b-4GS-1.39a and 1.92b-4gs-1.62a were tested in the epitope competition assay as described above. 1.92b-4GS-1.39a and 1.92b-4gs-1.62 did cross compete with 1.1-Strap tagged and 2.1-Strap tagged proteins for binding to the cells. EC50 are shown in the table 5 below.

TABLE 5

| Constructs | EC50 (M) | |
| --- | --- | --- |
|  | Epitope 1 (1.1) | Epitope 2 (2.1) |
| 1.92b-4GS-1.39a | 1.1E−09 | 1.2E−09 |
| 1.92b-4gs-2.12a | 1.0E−09 | 1.0E−09 |

Plates were incubated for a minimum of 1.5 hours at room temperature then fluorescence measured in the FL2 (502 nm-537 nm) and FL5 (677-800 nm) channels on the Mirrorball plate reader (TTP) following excitation at 488 nm and 640 nm. Data was expressed as a % of the total binding control (i.e. % control) after subtraction of the background signal determined from the non-specific binding control wells. Clones that showed improved activity compared to the parent $V_H$ were purified and tested multipoint in the Epitope Competition Assay for $IC_{50}$ determination or were tested directly in the reporter gene assay described below.

e) Epitope Mapping of Single Domain Antibody $V_H$ Single Domain Antibody that Bind to PD-1 but Do Not Block Ligand Binding The binding epitopes on PD-1 of $V_H$ single domain antibodies 1.1a and 1.51a were determined using peptide scanning analysis (PepScan). 1.1a in monovalent format was screened against arrays of PD-1 linear peptides and PD-1 peptides constrained to mimic loops and β-strands, with one residue offset between peptides in each set. 1.1a and 1.51a in bivalent format were screened against arrays combining discontinuous peptides.

Synthesis of peptides: To reconstruct continuous epitopes of huPD-1 extracellular domain, a library of peptides was synthesized. An amino functionalized polypropylene support was obtained by grafting with a proprietary hydrophilic polymer formulation, followed by reaction with t-butyloxy-carbonyl-hexamethylenediamine (BocHMDA) using dicyclohexylcarbodiimide (DCC) with Nhydroxybenzotriazole (HOBt) and subsequent cleavage of the Boc-groups using trifluoroacetic acid (TFA). Standard Fmoc-peptide synthesis was used to synthesize peptides on the amino-functionalized solid support by custom modified JANUS liquid handling stations (Perkin Elmer). Synthesis of structural mimics was done using Pepscan's proprietary Chemically Linked Peptides on Scaffolds (CLIPS) technology. CLIPS technology allows to structure peptides into single loops, double loops, triple loops, sheet-like folds, helix-like folds and combinations thereof. CLIPS templates are coupled to cysteine residues. The side-chains of multiple cysteines in the peptides are coupled to one or two CLIPS templates. For example, a 0.5 mM solution of the P2 CLIPS (2,6-bis (bromomethyl)pyridine) is dissolved in ammonium bicarbonate (20 mM, pH 7.8)/acetonitrile (1:3 (v/v)). This solution is added onto the peptide arrays. The CLIPS template will bind to side-chains of two cysteines as present in the solid-phase bound peptides of the peptide-arrays (455 wells plate with 3 μl wells). The peptide arrays are gently shaken in the solution for 30 to 60 minutes while completely covered in solution. Finally, the peptide arrays are washed extensively with excess of $H_2O$ and sonicated in disrupt-buffer containing 1% SDS/0.1% beta-mercaptoethanol in PBS (pH 7.2) at 70° C. for 30 minutes, followed by sonication in $H_2O$ for another 45 minutes. The T3 CLIPS carrying peptides were made in a similar way but now with three cysteines.

ELISA screening: The binding of antibody to each of the synthesized peptides was tested in a PEPSCAN-based ELISA. The peptide arrays were incubated with anti-His Tag monoclonal antibody (R&D) (overnight at 4° C.). After washing, the peptide arrays were incubated with a 1/1000 dilution of rabbit anti-mouse IgG (H+L) HRP conjugate (Southern Biotech) for one hour at 25° C. After washing, the peroxidase substrate 2,2'-azino-di-3-ethylbenzthiazoline sulfonate (ABTS) and 20 μl/ml of 3 percent H2O2 were added. After one hour, the color development was measured. The color development was quantified with a charge coupled device (CCD)—camera and an image processing system.

Data processing: The values obtained from the CCD camera range from 0 to 3000 mAU, similar to a standard 96-well plate ELISA-reader. The results are quantified and stored into the Peplab database. Occasionally a well contains an air-bubble resulting in a false-positive value, the cards are manually inspected, and any values caused by an air-bubble are scored as 0.

Synthesis quality control: To verify the quality of the synthesized peptides, a separate set of positive and negative control peptides was synthesized in parallel. These were screened with antibody 57.9 (Posthumus et al., J. Virology, 1990, 64:3304-3309).

When screened against linear peptides and peptides constrained to mimic loops and β-strands peptides, 1.1a shows consistent binding to a subset of peptides comprising the motif 102-NGRDFHMSVVRARR-115 (SEQ ID No. 1094). Binding to this epitope was observed over all sets of peptides tested and was independent of the structural restraints imposed upon the peptides.

Screened against discontinuous peptides, 1.1a displays binding to a subset of peptides comprising the motifs 33-NPPTFS-38 (SEQ ID No. 1095), 54-CSFSNTS-ESFVLNW-67 (SEQ ID No. 1096) and 101-PN-GRDFHMSV-110 (SEQ ID No. 1097). The data is consistent with binding to the epitope identified in the linear peptides and also identifies additional residues which are proximal to the linear epitope in the tertiary structure.

1.51a displayed affinity for a discontinuous set of peptides comprising the motifs 60-SESFVLNWYRMS-71 (SEQ ID No. 1098), 90-GQDCRFRVT-98 (SEQ ID No. 1099) and 104-RDFHMSVVRAR-114 (SEQ ID No. 1110). The identified sequences are proximal in the tertiary structure consistent with a discontinuous epitope.

Analysis of the huPD-1 structure (PDB code: 4ZQK) indicates that the identified epitopes for both 1.1a and 1.51a are located on the opposing face of the huPD-1 extracellular domain to that of the PD-L1 binding interface, consistent with binding to huPD-1 without interrupting native ligand binding.

The sequence 104-RDFHMSV-110 (SEQ ID No. 1111) is consistent within the epitopes identified for both Humabody VH. The partial overlap of epitopes is consistent with the two Humabody VH displaying competitive binding. The residues of human PD-1 involved in binding $V_H$ single domain antibody 1.1a are different from mouse PD-1 residues PD-1 (SEQ ID No. 1102).

f) Reporter Gene Assays

The ability of the $V_H$ to inhibit functional responses in a transfected Jurkat cells as a result of PD-1:PD-L1 blockade was assessed using an NFAT-Luciferase Reporter Gene assay. A Jurkat reporter cell line expressing human PD-1 and a luciferase reporter gene under the control of a promoter with an NFAT response element and a CHO cell line expressing a T-Cell Receptor activator and human PD-L1 under the control of a tetracycline inducible promotor were generated by standard methods. Cells were prepared in bulk, then frozen and stored in liquid nitrogen.

CHO human PD-L1/TCR activator cells were thawed in in a 37° C. water bath, washed once with PBS, resuspended in (Hams F12/10% FBS/1 µg/ml tetracycline) and plated at 10000 cells/well in a 96 well white TC treated assay plate. Plates were incubated at 37° C. overnight in a $CO_2$ incubator.

Samples were serially diluted in assay medium (RPM1+ 2% FBS). Jurkat PD-1 reporter cells were thawed in a 37° C. water bath, washed once with medium, then diluted into assay medium at $5e^5$ cells/ml. The media was removed from the CHO cells and 50 µl diluted sample or assay media (background control) added to the plates followed by 50 µl of the diluted Jurkat reporter cells. The plates were incubated for 6 hours at 37° C. in a $CO_2$ incubator, then removed from the incubator and equilibrated to room temperature for 10 mins. NanoGlo substrate (100 µl of substrate diluted 1:50 in NanGlo buffer Promega cat no. N1120) was added and the plates incubated for 10 mins at room temperature prior to measurement of luminescence signal (RLU). Data was expressed as fold/background signal. Alternatively, samples were tested using the PD-1/PD-L1 Blockade Bioassay System (Promega) according to the manufacturer's protocol.

Functional activity of multivalent $V_H$ constructs was also tested in the human PD-1 reporter gene assay as described above and $EC_{50}$ values determined. Example $EC_{50}$ data for activity in the reporter assay is shown in FIG. 10 and table 6. Non-blocking single domain antibodies showed no activity in the assay. Biparatopic format showed a 10-25 fold increase in the potency in the reporter assay compared to monovalent blocker.

TABLE 6

| Construct | EC50 (M) |
| --- | --- |
| 1.1b-2GS-1.1a | 7.2E−09 |
| 1.1b-4GS-1.1a | 8.5E−09 |
| 1.1b-6GS-1.1a | 1.1E−08 |
| 1.1a-4GS-1.57b | 3.9E−09 |
| 1.57b-4GS-1.1a | 1.7E−09 |
| 1.57b-4GS-MSA binder-4GS - 1.1a | 3.2E−09 |
| 1.57b-4GS-1.1a-4G- MSA binder | 2.5E−09 |
| 1.92b-4GS-1.39a | 2.0E−09 |
| 1.92b-4GS-1.62 | 1.2E−09 |
| 1.92b-4GS-1.39a-4GS-MSA binder | 4.7E−09 |
| 1.92b-4GS-1.99a | 1.0E−09 |
| 1.92b-4GS-1.103a | 1.2E−09 |
| 1.77b-1GS-1.21a | 2.3E−09 |
| 1.77b-2GS-1.21a | 2.1E−09 |
| 1.77b-4GS-1.21a | 3.2E−09 |
| 1.64b-4GS-1.1a | 3.0E−09 | g) Species Cross Reactivity Testing

Purified $V_H$ were tested for their ability to bind to human PD1 (R&D Systems cat no. 1086-PD), cynomolgus PD-1 (Acro Biosystems cat no. PD-1-05254) and mouse PD1 (R&D Systems cat no. 1021-PD) in an HTRF Binding assay format. All reagents and serially diluted $V_H$ were prepared in assay buffer containing PBS, 0.1% BSA and 0.4M Potassium Fluoride. Samples or assay buffer (non-specific binding) were incubated with 2 nM human/cynomolgus or mouse PD1, 1 nM Anti human-Fc Cryptate PAb (Cisbio cat. no. 61HFCKLB) and 30 nM anti His-D2 (CisBio cat no 61HISDLA) in black 384-shallow well assay plates for a minimum of 3 hours at room temperature. Time-resolved fluorescent emission at 620 nm and 665 nm was measured following excitation at 337 nm on the BMG PHERAstar plate reader. The HTRF ratio were calculated ((665 nm emission/620 nm emission)*10000) and the data corrected for (non-specific binding) to give the specific binding signal.

Monovalent $V_H$ single domain antibodies showed binding to human and cynomolgus PD-1 recombinant protein but did not cross react with mouse PD-1 protein. Biparatopic molecules tested also showed binding to human (FIG. 4a) and cynomolgus PD-1 (FIG. 4b) recombinant protein but did not cross react with mouse PD-1 protein (FIG. 4c). EC50 values are shown in the table 7 below.

TABLE 7

| Name | human PD1 $EC_{50}$ (M) | cyno PD1 $EC_{50}$ (M) | mouse PD1 $EC_{50}$ (M) |
| --- | --- | --- | --- |
| 1.1b-6GS-1.1a | 5.0E−10 | 9.2E−10 | No binding |
| 1.57b-4GS-1.1a | 1.2E−09 | 2.1E−09 | No binding |
| 1.57b-4GS-1.1a-4GS-MSA binder | 1.0E−09 | 1.6E−09 | No binding |
| 1.92b-4GS-1.39a | 2.1E−09 | 3.7E−09 | No binding |
| 1.92b-4GS-1.62a | 2.1E−09 | 3.9E−09 | No binding | h) Inhibition of Human PD-L1 and Human PDL-2 to CHO Human PD1 Cells

Purified $V_H$ were serially diluted in FMAT assay buffer and tested for binding to CHO human PD-1 cells as described above and for inhibition of human PD-L1/PD-L2 binding to CHO human PD-1 cells. All reagents and serially diluted $V_H$ were prepared in FMAT assay buffer. $V_H$, buffer (total binding controls) or excess competitor (non-specific binding control) were incubated with 400 pM human Fc tagged human PD-L1 or 100 pM PDL-2, 4 nM anti human Fc-Alexa Fluor-488 and 2000 per well CHO human PD-1 DRAQ5 stained cells in a 384 well black clear-bottomed assay plates. Plates were incubated for 2 hours at room temperature then fluorescence measured in the FL2 (502 nm-537 nm) and FL5 (677-800 nm) channels on the Mirrorball plate reader (TTP) following excitation at 488 nm and 640 nm. Data was expressed as a % of the total binding control (i.e. % control) after subtraction of the background signal determined from the non-specific binding control wells. The results are shown in FIG. 5 and in Tables 8 and 9 below.

TABLE 8

| (FIG. 5a) | |
| --- | --- |
| Name | CHO PD1:PDL1 $IC_{50}$ (M) |
| 1.1b | 2.3E−08 |
| 1.57b | 4.2E−09 |
| 1.1a | No Inhibition |
| 1.57b-4GS-1.1a | 1.3E−09 |
| 1.57b-4GS-1.1a-4GS-MSA binder | 4.4E−09 |
| 1.1b-4GS-1.1a | 5.6E−09 |

TABLE 9

| (FIG. 5b and c) | | | |
| --- | --- | --- | --- |
| Name | CHO PD1 binding EC50 (M) | CHO PD1:PDL1 $IC_{50}$ (M) | CHO PD1:PDL2 $IC_{50}$ (M) |
| 1.57b | | 1.8E−09 | 2.3E−09 |
| 1.57b-4GS-1.1a | | 9.0E−10 | 1.2E−09 |

TABLE 9-continued (FIG. 5b and c)

| Name | CHO PD1 binding EC50 (M) | CHO PD1:PDL1 IC$_{50}$ (M) | CHO PD1:PDL2 IC$_{50}$ (M) |
|---|---|---|---|
| 1.92b-4GS-1.39a | 0.2E−09 | 1.45E−09 | 1.9E−09 |
| 1.92b-4GS-1.62a | 0.2E−09 | 1.2E−09 | 1.6E−09 | i) Serum Stability

Serum stability of V$_H$ and multivalent V$_H$ constructs was assessed by measurement of their activity following incubation for 0, 1, 4 or 7 days both in mouse (Sigma M5905) and human serum. The pre-incubated samples were serially diluted and tested in either 1.51a or 1.57b or 1.1a epitope competition assay as described above. Minimal loss of activity was observed following incubation with serum. Example data is shown in FIG. 6 and table 10.

TABLE 10

| | IC 50 (M) | | | | | | | |
|---|---|---|---|---|---|---|---|---|
| | Day 0 | | Day 1 | | Day 4 | | Day 7 | |
| Constructs | Human | Mouse | Human | Mouse | Human | Mouse | Human | Mouse |
| 1.92b-4GS-1.39a | 0.9E−09 | 1.2E−09 | 0.9E−09 | 1.3E−09 | 1.1E−09 | 1.6E−09 | 1.0E−09 | 1.8E−09 |
| 1.92b-4GS-1.62a | 1.4E−09 | 1.7E−09 | 1.3E−09 | 2.0E−09 | 1.1E−09 | 1.8E−09 | 1.1E−09 | 2.0E−09 | j) Binding of V$_H$ to T-Cells

Binding of monovalent single domain antibodies and multivalent binding agents to T cells was measured using flow cytometry. Peripheral blood mononuclear cells (PBMCs) were isolated from human blood by density gradient centrifugation then CD4+ T cells purified using a negative selection isolation kit according to the manufacturer's protocol (Miltenyi Biotech cat no 130-096-533). T-cells were stimulated with 2.5 µg/ml PHA for 3 days in RPMI media supplemented with 10% FBS, 2 mM Glutamine, 1× Pen/Strep. Cells were transferred into 96 well plates (75000 per well), blocked for 10 mins with PBS/1% BSA, then incubated with serially diluted V$_H$ in staining buffer (PBS/1% BSA) for 1 hour at 4° C. Cells were washed with staining buffer by centrifugation then incubated with 10 µg/ml biotinylated Anti His antibody for 40 mins at 4° C. Cells were washed again then stained with Streptavidin Alexa Fluor-488 (10 µg/ml) and 1:5000 diluted Live Dead near IR stain (Molecular Probes cat no. L10119) for 30 mins at 4° C. After further washing cells were fixed and fluorescence measured by flow cytometry. EC50 data for staining of live cell gated CD4+ T cells is shown in table 11 below.

TABLE 11

| | CD4+ T cell binding EC50 (M) | | | |
|---|---|---|---|---|
| Name | Donor 1 | Donor 2 | Donor 3 | Donor 4 |
| 1.92b-4GS-1.39a | 0.5E−09 | 0.6E−09 | 0.6E−09 | 0.5E−09 |
| 1.92b-4GS-1.62a | 0.3E−09 | 0.4E−09 | 0.6E−09 | 0.3E−09 | k) Stability

Purified V$_H$ were subjected to size exclusion chromatography. Briefly, purified V$_H$ were stored at varied concentration in PBS buffer for 0-14 days at either 4° C. or 40° C., and then analysed at various time points using a Waters H-Class Bio UPLC containing a PDA detector (detection at 280 nm) with separation on a Waters ACQUITY BEH 125A SEC column. Samples were injected in 10 µl volumes and were run in a mobile phase containing 200 mM NaCl, 100 mM sodium phosphate, pH 7.4+5% propan-1-ol at a flow rate of 0.4 ml/min. Data were collected for 6 minutes and the area of monomer peak remaining after storage as compared to that present at the start (T=0) was calculated. Monovalent V$_H$ all showed good stability over 14 days at 4° C. or 40° C. Moreover, biparatopic V$_H$ was tested overnight and showed good stability as shown in Table 12 below.

TABLE 12

A

| Name | % Monomer | % 4° C. Monomer |
|---|---|---|
| 1.57b-4GS-1.1a-4GS-MSA binder | 97.58 | 99.33 |
| 1.92b-4GS-1.51 | 99.01 | 101.20 |
| 1.92b-4GS-1.103a | 98.95 | 97.30 |
| 1.92b-4GS-1.39a | 98.81 | 95.24 |
| 1.57b-4GS1.1a-4GS-MSA binder | 97.58 | 99.33 |
| 1.57b-4GS-1.1a | 100.0 | 95.22 |

B

| | 0 | 1 | 4 | 7 | 14 |
|---|---|---|---|---|---|
| 1.92b-4GS-1.62 | 100.00 | 101.20 | 98.50 | 94.05 | 92.41 | l) Effects of PD-1 Specific Humabody® on Human T Cell Activation in a Mixed Lymphocyte Reaction Monocytes were isolated from human peripheral blood mononuclear cells (PBMCs) and differentiated into dendritic cells for 7 days using STEMCELL Technologies Dendritic Cell Differentiation media or GM-CSF and IL-4. Dendritic cells were cultured with allogeneic CD4+ T cells, isolated from PBMCs via magnetic separation. Co-cultures were incubated for 2 days in the presence of PD-1-specific Humabody® or control. T cell stimulation was measured by proliferation assay or cytokine quantification from the cell supernatant.

1.1b-4GS-1.1a (FIG. 7a), 1.92b-4GS-1.39a and 1.92-4GS-1.62a (FIG. 7b) enhance IL-2 secretion from allogeneic dendritic cell/T cell co-culture in a concentration-dependent manner. IL-2 levels were determined after 2 or 3 days by Homogenous Time Resolved Fluorescence assay (HTRF, CisBio).

m) Binding Kinetics

Binding Affinity and Kinetic Constant Determination Using Strep Tagged Human PD-1

Single cycle kinetics assays were used to study the interaction between human PD-1 with Humabody VHs on a Biacore T200 instrument (GE Healthcare). Strep tagged recombinant human PD-1 was amine coupled to one flow cell of a CM-5 chip to create a low density surface (14 RU) using standard Biacore reagents. For the reference flow cell, a blank immobilisation was carried out. A five point, three-fold dilution series of each Humabody VH was made with a top concentration of 25 nM. The binding kinetics were followed by flowing the Humabody VH over the chip surface in HBS EP+ buffer at a flow rate of 30 µl/min. The contact time for each of the association steps was 180 seconds and the dissociation step was 3300 seconds. The data was fitted to a 1:1 binding model after double reference subtraction using the Biacore T200 Evaluation software. The calculated affinity and kinetic constants are shown in Table 13.

TABLE 13

| Humabody ® $V_H$ | ka (1/Ms) | Kd (1/s) | $K_D$ (M) |
|---|---|---|---|
| 1.57b | 4.05E+5 | 3.17E−5 | 7.82E−11 |
| 1.57b-4GS-1.1a | 4.37E+5 | 4.86E−5 | 1.11E−10 |
| 1.57b-4GS-1.1a-MSA binder | 3.49E+5 | 4.68E−5 | 1.34E−10 |

Binding Affinity and Kinetic Constant Determination Using Human PD-1-Fc

Single cycle kinetics assays were used to study the interaction between human Fc tagged human PD-1 with Humabody® $V_H$ on a Biacore T200 instrument (GE Healthcare). Protein G was amine coupled to two flow cells of a CM-5 chip. Human Fc tagged recombinant human PD-1 was captured onto one of the flow cells. The other was used as the reference flow cell. A five point, three-fold dilution series of each Humabody® $V_H$ was made with a top concentration within the range of 50 to 150 nM. The binding kinetics were followed by flowing the Humabody® $V_H$ over the chip surface in HBS EP+ buffer at a flow rate of 30 µl/min. The contact time for each of the association steps was 180 seconds and the dissociation step was 3600 seconds. The data was fitted to a 1:1 binding model after double reference subtraction using the Biacore T200 Evaluation software. The calculated affinity and kinetic constants are shown in Table 14.

TABLE 14

| Humabody ® $V_H$ | ka (1/Ms) | Kd (1/s) | $K_D$ (M) |
|---|---|---|---|
| 1.57b | 4.79E+5 | 2.11E−5 | 4.41E−11 |
| 1.57b-4GS-1.1a | 7.73E+5 | 4.59E−8 | 5.94E−14 |
| 1.57b-4GS-MSA binder-4GS-1.1a | 5.24E+5 | 4.23E−6 | 8.06E−12 |
| 1.57b-4GS-1.1a-4GS-MSA binder | 5.16E+5 | 2.67E−8 | 5.17E−14 |
| | 7.93E+5 | 1.32E−8 | 1.66E−14 |

Binding Kinetics of Certain Humabodies Binding to Human PD-1-hu Fc were Measured by Surface Plasmon Resonance (SPR) Technology Using Biacore Binding kinetics of certain humabodies binding to human PD-1-hu Fc were measured by surface plasmon resonance (SPR) technology using Biacore T200 instrument (GE Healthcare). Recombinant human PD-1-hu Fc was immobilized by standard amine coupling to CM5 sensorschip (GE Healthcare) using 0.1 mg/ml solution of antigen in 10 mM sodium acetate at pH 5.5. For the reference flow cell, a blank immobilisation was carried out. Single cycle kinetics assays were used to study the interaction, a five point, three-fold dilution series of each Humabody® $V_H$ was made with a top concentration of 30 nM. The binding kinetics were followed by flowing the Humabody® $V_H$ over the chip surface in HBS EP+ buffer at a flow rate of 30 µl/min. The contact time for each of the association steps was 180 seconds and the dissociation step was varied between 1200-3600 seconds. The data was fitted to a 1:1 binding model after double reference subtraction using the Biacore T200 Evaluation software. The calculated affinity and kinetic constants are shown in Table 15.

TABLE 15

| Humabody ® $V_H$ | Ka (1/Ms) | Kd (1/s) | KD (M) |
|---|---|---|---|
| 1.57b | 5.37E+05 | 6.68E−08 | 1.24E−13 |
| 1.1b-4GS-1.1a | 3.16E+05 | 1.10E−05 | 3.50E−11 |
| 1.1b-6GS-1.1a | 2.28E+05 | 6.39E−06 | 2.80E−11 |
| 1.1b-2GS-1.1a | 3.13E+05 | 1.08E−05 | 3.46E−11 |
| 1.1a | 1.09E+05 | 7.35E−05 | 6.76E−10 |
| 1.92b-4GS-1.39a | 5.1E+05 | 6.5E−06 | 1.2E−11 |
| 1.92b-4GS-1.62a | 4.4E+05 | 4.3E−06 | 9.7E−12 |

Binding kinetics for Humabody® 1.1a to human PD-1-hu Fc are shown below. These were measured in real-time bio-layer interferometer based biosensor Octet (ForteBio). Recombinant human PD-1-hu Fc was immobilized by standard amine coupling to amine reactive biosensors in 10 mM sodium acetate at pH 5.0. All the binding studies were performed in HBS-ET Octet kinetics buffer. Biosensors were always washed in Octet kinetics buffer in between different steps. A seven point, two-fold dilution series of each Humabody® $V_H$ was made with a top concentration of 30 nM. The contact time for each of the association steps was 300 seconds and the dissociation step was varied between 400-600 seconds. Kinetic association ($k_a$) and dissociation ($k_d$) rate constants were determined by processing and fitting the data to a 1:1 binding model using ForteBio Analysis software. The calculated affinity and kinetic constants are shown in Table 16.

TABLE 16

| Humabody ® $V_H$ | ka (1/Ms) | kd (1/s) | KD (M) |
|---|---|---|---|
| 1.1a | 4.59E+05 | 9.01E−04 | 1.96E−9 |

Example 11

In Vivo Efficacy of Binding Agent in HuGEMM PD1 Model with Subcutaneous MC38 Mouse Colon Adenocarcinoma The binding molecule tested was 1.57b-4GS-1.1a-4GS-MSA binder. 1.57b-4GS-1.1a-4GS-MSA binder 15 mg/kg q2D, Hel4-6GS-MSA binder 15 mg/kg q2D, benchmark human anti-PD antibody 10 mg/kg BIW. In all studies described herein, the benchmark human anti-PD antibody is based on a clinically validated human monoclonal anti-PD antibody.

Mice—HuGEMM PD-1, age 9-13 weeks, female mice

The mice were housed in individual ventilated cages (2-4 per cage) at the following conditions; temperature: 20-26° C., humidity 30-70%, photoperiod: 12 hours light and 12 hours dark, Polysulfone cage with size of 325 mm×210 mm×180 mm, bedding material is corn cob and changed weekly. Animals were given free access to irradiation sterilized dry granule food and sterile drinking water during the entire study period.

PD-1 HuGEMM is a type of genetically engineered mouse model (GEMM) with chimeric human/mouse PD-1 gene (h/mPD-1) containing humanized exon 2 in C57BL/6 mice Crown Biosciences). Each mouse was inoculated subcutaneously at the right hind flank with MC38 mouse colon adenocarcinoma cells (1×10$^6$) for tumor development. When average tumor size reached 50-100 mm$^3$, mice were randomly assigned into different study groups. After tumor inoculation, the animals were checked daily for morbidity and mortality. At the time of routine monitoring, the animals were checked for any effects of tumor growth and treatments on normal behavior such as mobility, food and water consumption, body weight gain/loss, eye/hair matting and any other abnormal effect. Tumor size was measured by caliper twice weekly in two dimensions. The tumor volume was expressed in mm$^3$ using the formula: TV=0.5 a×b$^2$ where a and b are the long and short diameters of the tumor, respectively. Body weight will be measured twice weekly.

Data is shown in FIG. 8. The Biparatopic PD-1 Humabody® was able to elicit tumour regressions in 4/6 of the mice demonstrating that in vivo it has potent anti-tumour activity compared to a non-specific Humabody® control. At the end of the study 4/6 of the mice treated with Biparatopic PD-1 Humabody® had no detectable tumours present. The study was repeated in order to analyse the cells within the tumour and the levels of cytokines. Mice between 6-8 weeks old were inoculated with MC38 cells. When tumour size reached 300 mm$^2$, mice were randomly grouped into 6 per treatment.

1.57b-4GS-1.1a 15 mg/kg q2D, Hel4-6GS-MSA binder 15 mg/kg q2D, benchmark human anti-PD antibody 10 mg/kg BIW. On day 7, tumours were harvested. Tumours were digested and stained for flow cytometry using a panel of antibodies for mouse cellular markers. Data is shown in table 17, percentage of live CD45+/marker+ within the tumour. The biparatopic PD-1 Humabody® treatment led to a trend in increased CD4+ T cells, CD8+ T cells, with a decline in T regulatory cells and macrophages.

TABLE 17

| Mouse | | Live cell | | | | | | | |
|---|---|---|---|---|---|---|---|---|---|
| | | CD45+ | G-MDSC | M-MDSC | Macrophage | CD4 T cell | Treg cell | CD8 T cell | NK cell |
| 1 | Control | 46.20 | 0.32 | 4.61 | 75.71 | 1.29 | 0.15 | 2.67 | 0.02 |
| 2 | Humabody | 59.30 | 0.15 | 3.42 | 74.67 | 2.71 | 0.51 | 4.89 | 0.08 |
| 3 | | 43.00 | 2.36 | 9.87 | 55.42 | 3.19 | 1.06 | 5.82 | 0.11 |
| 4 | | 55.10 | 0.22 | 4.12 | 79.14 | 1.53 | 0.21 | 0.00 | 0.00 |
| 5 | | 56.20 | 0.36 | 11.58 | 59.45 | 3.48 | 0.86 | 0.00 | 0.13 |
| 6 | | 53.80 | 0.37 | 6.06 | 75.37 | 1.15 | 0.17 | 0.97 | 0.15 |
| MEAN | | 52.27 | 0.63 | 6.61 | 69.96 | 2.23 | 0.50 | 2.39 | 0.08 |
| SD | | 6.29 | 0.85 | 3.35 | 9.90 | 1.02 | 0.39 | 2.51 | 0.06 |
| 7 | PD1 | 56.70 | 0.64 | 4.95 | 74.28 | 1.60 | 0.35 | 1.83 | 0.05 |
| 8 | Antibody | 39.40 | 1.04 | 4.89 | 64.94 | 2.21 | 0.46 | 2.91 | 0.00 |
| 9 | | 64.00 | 1.32 | 4.40 | 56.84 | 2.91 | 0.80 | 10.82 | 0.16 |
| 10 | | 67.80 | 0.14 | 4.00 | 55.47 | 4.96 | 0.42 | 7.57 | 0.16 |
| 11 | | 72.30 | 0.66 | 4.98 | 58.68 | 2.50 | 0.00 | 6.80 | 0.09 |
| 12 | | 56.20 | 0.39 | 7.05 | 60.15 | 1.42 | 0.28 | 2.85 | 0.00 |
| MEAN | | 59.40 | 0.70 | 5.05 | 61.73 | 2.60 | 0.39 | 5.46 | 0.08 |
| SD | | 11.62 | 0.43 | 1.06 | 6.97 | 1.28 | 0.26 | 3.51 | 0.07 |
| 13 | 1.57b- | 53.30 | 1.23 | 10.93 | 52.86 | 1.14 | 0.27 | 1.07 | 0.37 |
| 14 | 4GS- | 65.70 | 0.43 | 4.11 | 49.37 | 9.22 | 0.19 | 6.29 | 0.10 |
| 15 | 1.1a | 57.20 | 0.16 | 10.43 | 62.04 | 2.07 | 0.00 | 3.23 | 0.12 |
| 16 | | 69.80 | 0.38 | 3.24 | 56.74 | 2.48 | 0.00 | 4.54 | 0.07 |
| 17 | | 67.70 | 0.67 | 7.06 | 40.75 | 5.14 | 0.32 | 5.48 | 0.10 |
| 18 | | 64.90 | 0.23 | 4.82 | 58.20 | 2.12 | 0.48 | 6.95 | 0.08 |
| MEAN | | 63.10 | 0.52 | 6.76 | 53.33 | 3.69 | 0.21 | 4.59 | 0.14 |
| SD | | 6.43 | 0.39 | 3.29 | 7.55 | 3.02 | 0.19 | 2.17 | 0.11 |

To analyse the levels of cytokines within serum and the tumour, LUMINEX® assay was used. This assay is an immunoassay that quantifies multiple analyte such as cytokines (Luminexcorp.com). Data is shown in table 18—concentration of cytokines within serum and table 19—concentration of cytokines within tumour. Interestingly, there is elevation of some cytokines in the tumour in response to the biparatopic molecule, i.e., interferon-gamma, IL-1α, IL-1β, IL-5, IL-6 and MIP-1α are increased relative to negative control and human PD-1 antibody treatment (based on a mean of the group of animals used in the study). There is elevation of cytokines IL-6, IL-5, IL-12 and IL-1β in the serum following treatment with PD-1 antibody but not biparatopic. This is based on mean values and a larger group size is required to represent a range in tumour responses.

TABLE 18

Cytokines within serum from mouse with MC38 tumour, post-treatment.

| Mouse | Group | FGF basic pg/ml | IL-1beta pg/ml | IL-10 pg/ml | IL-13 pg/ml | IL-6 pg/ml | IL-12 (P40/P70) pg/ml | IL-17 pg/ml | MIP-1alpha pg/ml | GM-CSF pg/ml | MCP-1 pg/ml |
|---|---|---|---|---|---|---|---|---|---|---|---|
| 1 | control | 181.28 | 133.05 | <130.53↓ | <34.40↓ | 51.7 | 26.49 | 7.97 | 34.8 | <22.75↓ | 131.03 |
| 2 | Humabody | 142.3 | 57.23 | <130.53↓ | 56.88 | 20.97 | 56.3 | 8.92 | 32.93 | <22.75↓ | 44.02 |
| 3 | | 158.27 | 57.23 | <130.53↓ | 118.07 | 32.79 | 39.15 | 19.24 | 32.93 | <22.75↓ | 71.56 |
| 4 | | 168.63 | 74.39 | <130.53↓ | <34.40↓ | 11.47 | 53.79 | 7.26 | 42.43 | <22.75↓ | 113.76 |
| 5 | | <118.17↓ | 39.21 | <130.53↓ | <34.40↓ | 18.74 | 38.42 | <3.44↓ | <29.55↓ | <22.75↓ | 15.62 |
| 6 | | 136.85 | 79.15 | <130.53↓ | <34.40↓ | 38.98 | 15.86 | 6.68 | 31.08 | <22.75↓ | 107.82 |
| 7 | PD1 | 122.94 | 59.74 | <130.53↓ | <34.40↓ | 20.97 | 46.55 | <3.44↓ | <29.55↓ | <22.75↓ | 61.45 |
| 8 | Antibody | 169.91 | 76.78 | <130.53↓ | <34.40↓ | 65.32 | 106.78 | <3.44↓ | 157.89 | <22.75↓ | 236.31 |
| 9 | | <118.17↓ | 39.21 | <130.53↓ | <34.40↓ | 16.57 | 54.79 | <3.44↓ | 46.33 | <22.75↓ | 19.06 |
| 10 | | 139.58 | 307.29 | <130.53↓ | <34.40↓ | 245.12 | 120.3 | 26.87 | 147.02 | 77.93 | 34.19 |
| 11 | | 200.87 | 64.69 | <130.53↓ | <34.40↓ | 79.69 | 39.89 | 5.43 | 32.93 | <22.75↓ | 129.62 |
| 12 | | 136.85 | 74.39 | <130.53↓ | <34.40↓ | 19.85 | 37.44 | 4.61 | 38.59 | <22.75↓ | 69.89 |
| 13 | 1.57b- | <118.17↓ | 52.17 | <130.53↓ | 58.25 | 25.58 | 53.79 | 3.82 | <29.55↓ | <22.75↓ | 122.49 |
| 14 | 4GS- | <118.17↓ | 97.57 | <130.53↓ | <34.40↓ | 79.04 | 85.1 | 13.12 | 62.31 | <22.75↓ | 310.97 |
| 15 | 1.1a | 125.76 | 47.04 | <130.53↓ | 110.19 | 17.65 | 36.47 | <3.44↓ | <29.55↓ | <22.75↓ | 13.94 |
| 16 | | 150.35 | 59.74 | <130.53↓ | 47.55 | 16.04 | 24.65 | 6.11 | <29.55↓ | <22.75↓ | 33.29 |
| 17 | | <118.17↓ | 48.33 | <130.53↓ | 63.8 | 13.45 | 37.44 | <3.44↓ | <29.55↓ | <22.75↓ | 22.57 |
| 18 | | 198.46 | 44.45 | <130.53↓ | 54.17 | 36.49 | 84.59 | <3.44↓ | <29.55↓ | <22.75↓ | 13.94 |

| Mouse | Group | IL-5 pg/ml | VEGF pg/ml | IL-1alpha pg/ml | IFN-gamma pg/ml | TNF-alpha pg/ml | IL-2 pg/ml | IP-10 pg/ml | MIG pg/ml | KC pg/ml | IL-4 pg/ml |
|---|---|---|---|---|---|---|---|---|---|---|---|
| 1 | control | 54.45 | 264.76 | <39.08↓ | 45.59 | <78.60↓ | <13.86↓ | 501.55 | 1410 | <113.93↓ | <104.29↓ |
| 2 | Humabody | 14.69 | 8.42 | <39.08↓ | 40.73 | <78.60↓ | <13.86↓ | 220.67 | 1117 | <113.93↓ | <104.29↓ |
| 3 | | 15.85 | 7.59 | <39.08↓ | 26.34 | <78.60↓ | 14.19 | 125.98 | 855.88 | 451.54 | <104.29↓ |
| 4 | | 11.34 | 6.94 | 47.35 | 21.69 | <78.60↓ | <13.86↓ | 274.63 | 1386 | <113.93↓ | <104.29↓ |
| 5 | | 8.25 | <2.87↓ | <39.08↓ | <19.06↓ | <78.60↓ | <13.86↓ | 60.37 | 750.73 | <113.93↓ | <104.29↓ |
| 6 | | 18.24 | 6.94 | <39.08↓ | <19.06↓ | <78.60↓ | <13.86↓ | 242.24 | 645.83 | <113.93↓ | <104.29↓ |
| 7 | PD1 | 28.39 | 11.94 | <39.08↓ | <19.06↓ | <78.60↓ | <13.86↓ | 261.12 | 1267 | <113.93↓ | <104.29↓ |
| 8 | Antibody | 118.98 | 11.04 | <39.08↓ | 94.97 | <78.60↓ | <13.86↓ | 225.1 | 2023 | 622.1 | <104.29↓ |
| 9 | | 27.08 | 4.02 | <39.08↓ | 19.42 | <78.60↓ | <13.86↓ | 96.29 | 1099 | <113.93↓ | <104.29↓ |
| 10 | | 380.14 | 5.53 | <39.08↓ | 170.29 | <78.60↓ | <13.86↓ | 177.31 | 908.43 | <113.93↓ | 129.82 |
| 11 | | 15.26 | 3.36 | <39.08↓ | 45.59 | <78.60↓ | <13.86↓ | 84.05 | 887.84 | 139.3 | <104.29↓ |
| 12 | | 31.04 | 17.06 | <39.08↓ | <19.06↓ | <78.60↓ | <13.86↓ | 211.51 | 1250 | <113.93↓ | <104.29↓ |
| 13 | 1.57b- | 13.55 | 7.67 | <39.08↓ | <19.06↓ | <78.60↓ | <13.86↓ | 317.41 | 1475 | <113.93↓ | <104.29↓ |
| 14 | 4GS- | 20.69 | 2.92 | 53.87 | 212.45 | 79.45 | <13.86↓ | 215.87 | 950.8 | <113.93↓ | <104.29↓ |
| 15 | 1.1a | 5.51 | 6.3 | <39.08↓ | <19.06↓ | <78.60↓ | <13.86↓ | 105.16 | 861.13 | <113.93↓ | <104.29↓ |
| 16 | | 14.69 | 6.38 | <39.08↓ | 26.34 | <78.60↓ | <13.86↓ | 245.71 | 1681 | <113.93↓ | <104.29↓ |
| 17 | | 17.03 | 7.83 | <39.08↓ | 21.69 | <78.60↓ | <13.86↓ | 232.49 | 1304 | <113.93↓ | <104.29↓ |
| 18 | | 18.24 | 6.15 | <39.08↓ | <19.06↓ | <78.60↓ | <13.86↓ | 120.69 | 965.14 | <113.93↓ | <104.29↓ |

TABLE 19

Cytokine concentration within MC38 tumours after treatment

| Mouse | Group | FGF basic pg/ml | IL-1beta pg/ml | IL-10 pg/ml | IL-13 pg/ml | IL-6 pg/ml | IL-12 (P40/P70) pg/ml | IL-17 pg/ml | MIP-1alpha pg/ml | GM-CSF pg/ml | MCP-1 pg/ml |
|---|---|---|---|---|---|---|---|---|---|---|---|
| 1 | control | 2024 | 229.3 | 308.06 | 31 | 48.07 | 228.55 | <1.67↓ | 1061 | 17.7 | 5202 |
| 2 | Humabody | 3515 | 401.01 | 320.52 | 41.82 | 105.19 | 296.47 | <1.67↓ | 1220 | 35.57 | 5001 |
| 3 | | 3948 | 331.32 | 234.92 | 29.69 | 62.4 | 220.26 | <1.67↓ | 546.73 | 20.96 | 3196 |
| 4 | | 3321 | 344.33 | 258.94 | 32.76 | 118.63 | 217.83 | <1.67↓ | 814.75 | 20.15 | 4803 |
| 6 | | 2326 | 254.15 | 258.94 | 24.14 | 77.3 | 179.44 | <1.67↓ | 792.88 | 19.74 | 4625 |
| 7 | PD1 | 3548 | 353.89 | 246.88 | 34.55 | 113.09 | 325.64 | <1.67↓ | 958.88 | 18.93 | 3233 |
| 8 | Antibody | 3326 | 226.32 | 304.95 | 43.66 | 48.48 | 174.54 | <1.67↓ | 848.72 | 13.19 | 4726 |
| 9 | | 5953 | 468.28 | 228.98 | 36.34 | 860.54 | 294.23 | <1.67↓ | 1025 | 20.96 | 3340 |
| 10 | | 2008 | 338.45 | 268.04 | 26.67 | 51.36 | 360.3 | <1.67↓ | 1003 | 18.93 | 3397 |
| 11 | | 4260 | 175.63 | 1117 | 30.56 | 121.3 | 262.35 | <1.67↓ | 263.1 | <11.44↓ | 93.92 |
| 12 | | 1556 | 258.68 | 308.06 | 37.7 | 50.13 | 354.4 | <1.67↓ | 950.34 | 22.58 | 7197 |
| 13 | 1.57b- | 3454 | 384.55 | 277.6 | 29.69 | 3139 | 211.6 | <1.67↓ | 1079 | 15.65 | 5718 |
| 14 | 4GS- | 2738 | 236.55 | 217.2 | 17.69 | 90.37 | 214.72 | <1.67↓ | 1275 | 14.01 | 4639 |
| 16 | 1.1a | 5126 | 506.63 | 237.9 | 18.86 | 81.09 | 153.65 | <1.67↓ | 1149 | 14.01 | 3920 |
| 17 | | 3188 | 525.65 | 301.85 | 41.36 | 55.46 | 171.04 | <1.67↓ | 1242 | 29.35 | 5644 |
| 18 | | 1857 | 587.97 | 283.33 | 27.1 | 800.34 | 274.41 | <1.67↓ | 1075 | 13.19 | 2649 |

TABLE 19-continued

Cytokine concentration within MC38 tumours after treatment

| Mouse | Group | IL-5 pg/ml | VEGF pg/ml | IL-1alpha pg/ml | IFN-gamma pg/ml | TNF-alpha pg/ml | IL-2 pg/ml | IP-10 pg/ml | MIG pg/ml | KC pg/ml | IL-4 pg/ml |
|---|---|---|---|---|---|---|---|---|---|---|---|
| 1 | control | 49.79 | 6958 | 104.18 | 224.18 | <41.39↓ | 50.31 | 2002 | 1997 | 1932 | <50.35↓ |
| 2 | Humabody | 73.72 | 10826 | 278.83 | 485.05 | 59.12 | 59.99 | 1177 | 1771 | 2100 | 1912 |
| 3 | | 33.34 | 3903 | 166.94 | 97.62 | <41.39↓ | 40.01 | 195.67 | 571.61 | 1124 | 8241 |
| 4 | | 44.48 | 8116 | 162.31 | 252.8 | <41.39↓ | 47.03 | 976.57 | 1847 | 2058 | <50.35↓ |
| 6 | | 39.95 | 4722 | 114.33 | 155.05 | <41.39↓ | 39.51 | 765.94 | 1504 | 1470 | <50.35↓ |
| 7 | PD1 | 92.08 | 5636 | 240.79 | 271.99 | <41.39↓ | 62.56 | 800.56 | 1849 | 1168 | <50.35↓ |
| 8 | Antibody | 36.65 | 10886 | 152.14 | 197.04 | <41.39↓ | 24.88 | 1093 | 1891 | 1612 | <50.35↓ |
| 9 | | 81.07 | 7753 | 374.04 | 324.9 | 48.94 | 34.53 | 633.62 | 1677 | 2280 | <50.35↓ |
| 10 | | 44.48 | 3473 | 178.44 | 298.37 | <41.39↓ | 129.16 | 464.88 | 1090 | 748.1 | 398.33 |
| 11 | | 4.84 | 161.26 | 75.32 | 40.92 | <41.39↓ | 46.93 | 171.88 | 2215 | 457.55 | <50.35↓ |
| 12 | | 65.86 | 9745 | 227.27 | 290.57 | 53.33 | 63.07 | 1627 | 2193 | 3174 | <50.35↓ |
| 13 | 1.57b- | 56.28 | 7702 | 133.32 | 328.6 | <41.39↓ | 118.89 | 1285 | 1875 | 1724 | <50.35↓ |
| 14 | 4GS- | 41.6 | 5336 | 222.84 | 287.95 | <41.39↓ | 44.39 | 824.8 | 1276 | 1776 | <50.35↓ |
| 16 | 1.1a | 57.08 | 3051 | 543.63 | 306.06 | <41.39↓ | 37.81 | 275.66 | 655.99 | 1590 | <50.35↓ |
| 17 | | 99.9 | 7509 | 645.24 | 638.23 | 43.38 | 58.86 | 1230 | 1872 | 1447 | <50.35↓ |
| 18 | | 82.22 | 5968 | 328.08 | 382.95 | <41.39↓ | 28.32 | 449.71 | 1442 | 293.79 | <50.35↓ |

Example 12

In Vivo Efficacy of Binding Agent in hu-CD34 NSG™ Mice

The study was conducted by In Vivo Services at The Jackson Laboratory Sacramento facility, an OLAW-assured and AAALAC-accredited organization. This study was performed according to an IACUC-approved protocol and in compliance with the Guide for the Care and Use of Laboratory Animals (National Research Council, 2011).

hu-CD34 NSG™ mice engrafted with human CD34+ cells and having >25% human CD45+ cells in the peripheral blood 12 weeks post engraftment or later were used for the study. Cohorts of hu-CD34 NSG™ mice engrafted with CD34+ cells from 2 or more donors were used. Mice were housed in individually and positively ventilated polysulfone cages with HEPA filtered air at a density of 4-5 mice per cage. The animal room was lighted entirely with artificial fluorescent lighting, with a controlled 12 h light/dark cycle (6 am to 6 pm light). The normal temperature and relative humidity ranges in the animal rooms were 22±4° C. and 50±15%, respectively. The animal rooms were set to have up to 15 air exchanges per hour. Filtered tap water, acidified to a pH of 2.5 to 3.0, and normal rodent chow was provided ad libitum.

Hu-CD34 NSG™ mice from three CD34 donors (2126, 2122, 5046) were implanted subcutaneously on the right flank with tumor fragments from PDX model BR1126. Body weights and clinical observations were recorded 1× weekly. Digital caliper measurements were initiated to determine tumor volume 2× weekly when tumors became palpable.

Mice were randomized based on tumor volumes when the tumor volumes reached approximately 60-100 mm3. Humanized NSG engrafted from different donors were distributed across different study groups across study groups.

Mice were dosed according to the following dosing schedules; test compounds were dosed from day 0 at 15 mg/kg IP every other day for 10 doses; Antibody was dosed at 10 mg/kg IP on day 0 and then 5 mg/kg every 5 days for an additional 3 doses.

Body weights, clinical observations, and digital caliper measurements were recorded 2× weekly post dose initiation. Animals that reached a body condition score of a body weight loss of ≥20%, or a tumor volume >2000 mm3 were euthanized before study terminus. Animals with ulcerated tumors were also euthanized before study terminus.

All animals were euthanized by CO2 asphyxiation on Study Day 27.

Data is shown in FIG. 9. The PD-1 Humabody® was active in vivo as it delayed the growth of BR1126 tumours so that the tumours were smaller at the endpoint in animals treated with the PD-1 Humabody® compared to those treated with the Control Humabody® or the Benchmark human anti-PD-1 antibody. In this model the Benchmark human anti-PD-1 mAb was not active, demonstrating that in this model the Humabody® was able to delay tumour growth even though the PD-1 mAb was not able to do so. In this experiment the HUMABODY® $V_H$ therefore showed differential and improved activity compared to the benchmark antibody.

Example 13

Profiling of Single Domain Antibodies Using DiscoverX BioMAP® Platform

Single domain antibodies were profiled in the BioMAP® Oncology CRC panel (DiscoverX). In this system HT29 human colorectal adenocarcinoma cells are co-cultured with peripheral blood mononuclear cells (PBMC) plus either human stromal fibroblasts (StroHT29) or human endothelial cells (HT29Vasc). HUMABODY® $V_H$ or human benchmark antibody products were added to each co-culture system at the stated concentrations. On completion of the co-culture the level of a panel of soluble and cell surface biomarkers was measured. These biomarkers were VCAM-1, uPAR, Collagen I, Collagen III, IP-10, MMP-9, PAI-1, PBMC Cytotoxicity, sGranzyme B, sIFNy, sIL10, sIL17A, sIL-2, sIL-6, SRB, sTNFa, sVEGF, TIMP2, tPA, uPA, CEACAM5, Keratin 20 for the HT29Stro system and MCP-1, VCMA-1, CD40, CD69, uPAR, Collagen IV, IP-10, MIG, PBMC cytotoxicity, sGranzyme B, sIFNy, sIL10, sIL17, sIL-2, sIL-6, SRB, sTNFa, CEACAM5, Keratin 20 for the HT29Vasc system. The change in each biomarker in co-cultures treated with titrated test compounds was compared to vehicle control. The StroHT29 system compared 1.57b-4GS-1.1a-MSA binder with PD1 antibody and Hel4-MSA control. Levels of biomarkers are shown as log[compound/vehicle control] in table 20. There is enhancement of IFN-gamma, IL-10, IL-17A, IL-2, IL-6 and TNFα above negative control and PD-1 antibody. IL-2 and TNFa are selectively increased by the biparatopic HUMABODY® $V_H$.

TABLE 20

| | 1.57b-4GS-1.1a-MSA binder | PD1 Antibody | Control Humabody |
|---|---|---|---|
| StroHT29: CD106/VCAM-1 | −0.03697 | −0.00790 | −0.01859 |
| StroHT29: CD87/uPAR | −0.03751 | −0.02754 | −0.02146 |
| StroHT29: CEACAM5/CD66e | −0.03303 | 0.00989 | 0.02234 |
| StroHT29: Collagen I | −0.03888 | −0.04974 | −0.01992 |
| StroHT29: Collagen III | −0.04540 | −0.01170 | −0.08098 |
| StroHT29: CXCL10/IP-10 | 0.02990 | 0.03660 | 0.01287 |
| StroHT29: Keratin 20 | −0.03369 | −0.01809 | 0.01166 |
| StroHT29: MMP-9 | −0.06597 | 0.02115 | −0.04475 |
| StroHT29: PAI-I | −0.01772 | −0.01267 | −0.03227 |
| StroHT29: PBMC Cytotoxicity | 0.01308 | 0.01204 | −0.00153 |
| StroHT29: sGranzyme B | 0.08496 | 0.08236 | −0.00243 |
| StroHT29: sIFNg | 0.18766 | 0.17204 | 0.04054 |
| StroHT29: sIL-10 | 0.18629 | 0.11784 | 0.05998 |
| StroHT29: sIL-17A | 0.21836 | 0.19140 | 0.10588 |
| StroHT29: sIL-2 | 0.12322 | 0.04879 | 0.02388 |
| StroHT29: sIL-6 | 0.22557 | 0.20076 | 0.16220 |
| StroHT29: SRB | −0.11365 | −0.01224 | −0.01090 |
| StroHT29: sTNF-alpha | 0.17256 | 0.02807 | 0.04633 |
| StroHT29: sVEGF | −0.08799 | −0.04929 | 0.11201 |
| StroHT29: TIMP-2 | −0.02947 | −0.01306 | −0.01625 |
| StroHT29: tPA | −0.05224 | 0.01139 | −0.02078 |
| StroHT29: uPA | −0.04715 | −0.03756 | −0.03338 |

1.1b-4GS-1.1a was also tested in the HT29Vasc system and a similar cytokine response was seen (table 21).

TABLE 21

| | 1.1b-4GS-1.1a | Control Humabody |
|---|---|---|
| VascHT29: CCL2/MCP-1 | −0.00465 | −0.00497 |
| VascHT29: CD106/VCAM-1 | −0.01501 | −0.01755 |
| VascHT29: CD40 | 0.00261 | −0.00387 |
| VascHT29: CD69 | −0.00186 | 0.01155 |
| VascHT29: CD87/uPAR | 0.00770 | 0.03942 |
| VascHT29: CEACAM5/CD66e | 0.05140 | 0.03777 |
| VascHT29: Collagen IV | 0.01177 | 0.00382 |
| VascHT29: CXCL10/IP-10 | −0.00423 | −0.00179 |
| VascHT29: CXCL9/MIG | 0.01572 | −0.01307 |
| VascHT29: Keratin 20 | 0.02528 | −0.00878 |
| VascHT29: PBMC Cytotoxicity | −0.00558 | −0.00379 |
| VascHT29: sGranzyme B | 0.09109 | 0.04891 |
| VascHT29: sIFNg | 0.30032 | 0.10817 |
| VascHT29: sIL-10 | 0.20605 | 0.09169 |
| VascHT29: sIL-17A | 0.25324 | 0.04345 |
| VascHT29: sIL-2 | 0.12758 | 0.06461 |
| VascHT29: sIL-6 | 0.18301 | 0.09370 |
| VascHT29: SRB | −0.01081 | 0.02561 |
| VascHT29: sTNF-alpha | 0.15879 | 0.10858 |

Example 14

PD-1 Stimulation

Experiments were performed using DiscoverX PathHunter® Checkpoint assay, which measures PD-1 signalling. cells expressed PD1 linked to an intracellular enzyme fragment and SH2-domain containing phosphatase linked to another enzyme fragment. Upon dimerization of receptor, complementation of the enzyme occurs. Substrate addition leads to chemiluminescent signal. PD-1 dimerization occurs in response to a PD-L1+ cell line. In absence of ligand, this dimerization could be induced by antibodies. PD1+ cells were incubated with a dilution series of HUMABODY® $V_H$ for 3 hours before addition of detection reagent. Chemiluminescence was read as relative light units and EC50 was calculated from curve fit. Maximum response was calculated as percentage increase in RLU above basal response. Table 22 Biparatopic HUMABODY® $V_H$ 1.77b-1GS-1.21a enhances PD-1 signalling.

A biparatopic molecule comprising is capable of PD1 agonism. A shorter linker increases this further, which is likely to be caused by enhanced cross-linking.

TABLE 22

| | EC50 uM | Max. % increase in response over baseline |
|---|---|---|
| 1.77b-1GS-1.21a | 0.00059 | 1332 |
| 1.77b-4GS-1.21a | 0.0005 | 253.2 |
| 1.77b-4GS-1.77b | 0.0002 | 48.54 |

SEQUENCE LISTING (1120 sequences)

SEQ ID NO: 1 - protein, 5 aa, Homo sapiens
  source: /note="CDR1 sequence of SEQ ID NO: 4"
DHAMH

SEQ ID NO: 2 - protein, 17 aa, Homo sapiens
  source: /note="CDR2 sequence of SEQ ID NO: 4"
GISWNSGSMGYADSVKD

SEQ ID NO: 3 - protein, 18 aa, Homo sapiens
  source: /note="CDR3 sequence of SEQ ID NO: 4"
EKGPGLTGSTADYYGLDV

SEQ ID NO: 4 - protein, 127 aa, Homo sapiens
  source: /note="VH 1.1a"
EVQLLESGGGSVQPGRSLRLSCAASGFTFDDHAMHWVRQAPGKGLEWVSGISWNSGSMGYADSVKDRFTISRDNAKSSLYLQMNSLRAEDTALYYCVREKGPGLTGSTADYYGLDVWGQGTMVTVSS

SEQ ID NO: 5 - protein, 5 aa, Homo sapiens
  source: /note="CDR1 sequence of SEQ ID NO: 8"
DYAMH

SEQ ID NO: 6 - protein, 17 aa, Homo sapiens
  source: /note="CDR2 sequence of SEQ ID NO: 8"
GISWNGGSMGYAASVKG

SEQ ID NO: 7 - protein, 18 aa, Homo sapiens
  source: /note="CDR3 sequence of SEQ ID NO: 8"
DKGPGLIGSTADYYGLDV

SEQ ID NO: 8 - protein, 127 aa, Homo sapiens
  source: /note="VH 1.2a"
EVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVKDKGPGLIGSTADYYGLDVWGQGTTVTVSS

SEQ ID NO: 9 - protein, 5 aa, Homo sapiens
  source: /note="CDR1 sequence of SEQ ID NO: 12"
DYAMH

SEQ ID NO: 10 - protein, 17 aa, Homo sapiens
  source: /note="CDR2 sequence of SEQ ID NO: 12"
GISWNSGSMGYADSVKD

SEQ ID NO: 11 - protein, 18 aa, Homo sapiens
  source: /note="CDR3 sequence of SEQ ID NO: 12"
DKGPGLIGSTADYHGLDV

SEQ ID NO: 12 - protein, 127 aa, Homo sapiens
  source: /note="VH 1.3a"
EVQLLESGGGLVQPGRSLRLSCAASGFTFDDYAMHWVRQAPGKGREWVSGISWNSGSMGYADSVKDRFTISRDNAKNSLYLQMNSLRAEDTALYYCVKDKGPGLIGSTADYHGLDVWGQGTTVTVSS

SEQ ID NO: 13 - protein, 5 aa, Homo sapiens
  source: /note="CDR1 sequence of SEQ ID NO: 16"
DYAMH

SEQ ID NO: 14 - protein, 17 aa, Homo sapiens
  source: /note="CDR2 sequence of SEQ ID NO: 16"
GISWNGGSMGYAESVKG

SEQ ID NO: 15 - protein, 18 aa, Homo sapiens
  source: /note="CDR3 sequence of SEQ ID NO: 16"
DKGPGLTGTTADYYGMDV

SEQ ID NO: 16 - protein, 127 aa, Homo sapiens
  source: /note="VH 1.4a"
EVQLLESGGGLVQPGRSLRLSCAASGFTFADYAMHWVRQAPGKGREWVSGISWNGGSMGYAESVKGRFTISRDNAKNSLYLQMNSLRAEDSALYYCVKDKGPGLTGTTADYYGMDVWGQGTTVTVSS

SEQ ID NO: 17 - protein, 5 aa, Homo sapiens
  source: /note="CDR1 sequence of SEQ ID NO: 20"
DYAMH

SEQ ID NO: 18 - protein, 17 aa, Homo sapiens
  source: /note="CDR2 sequence of SEQ ID NO: 20"
GISWNGGSMGYADSVKD

SEQ ID NO: 19 - protein, 18 aa, Homo sapiens
  source: /note="CDR3 sequence of SEQ ID NO: 20"
DKGPGLIGSTADYHGLDV

SEQ ID NO: 20 - protein, 127 aa, Homo sapiens
  source: /note="VH 1.5a"
EVQLVESGGGLVQPGRSLRLSCAASGFTFDDYAMHWVRQAPGKGLEWVSGISWNGGSMGYADSVKDRFTISRDNAKNSLYLQMNRLRAEDTALYYCVKDKGPGLIGSTADYHGLDVWGQGTTVTVSS

SEQ ID NO: 21 - protein, 5 aa, Homo sapiens
  source: /note="CDR1 sequence of SEQ ID NO: 24"
SYAMH

SEQ ID NO: 22 - protein, 17 aa, Homo sapiens
  source: /note="CDR2 sequence of SEQ ID NO: 24"
GISWNSGSMGYAESVKG

SEQ ID NO: 23 - protein, 18 aa, Homo sapiens
  source: /note="CDR3 sequence of SEQ ID NO: 24"
DKGPGLTGTTADYYGMDV

SEQ ID NO: 24 - protein, 127 aa, Homo sapiens
  source: /note="VH 1.6a"
EVQLVESGGGVVQPGRSLRLSCAASGFTFSSYAMHWVRQAPGKGREWVSGISWNSGSMGYAESVKGRFTISRDNAKNSLYLQMNSLRAEDSALYYCVKDKGPGLTGTTADYYGMDVWGQGTTVTVSS

SEQ ID NO: 25 - protein, 5 aa, Homo sapiens
  source: /note="CDR1 sequence of SEQ ID NO: 28"
DYAMH

SEQ ID NO: 26 - protein, 17 aa, Homo sapiens
  source: /note="CDR2 sequence of SEQ ID NO: 28"
GISWNGGSMGYAESVKG

SEQ ID NO: 27 - protein, 18 aa, Homo sapiens
  source: /note="CDR3 sequence of SEQ ID NO: 28"
DKGPGLTGTTADYYGMDV

SEQ ID NO: 28 - protein, 127 aa, Homo sapiens
  source: /note="VH 1.7a"
EVQLVESGGGVIQPGRSLRLSCAASGFTFDDYAMHWVRQAPGKGREWVSGISWNGGSMGYAESVKGRFTISRDNAQNSLYLQMNSLRAEDSALYYCVKDKGPGLTGTTADYYGMDVWGQGTTVTVSS

SEQ ID NO: 29 - protein, 5 aa, Homo sapiens
  source: /note="CDR1 sequence of SEQ ID NO: 32"
DYAMH

SEQ ID NO: 30 - protein, 17 aa, Homo sapiens
  source: /note="CDR2 sequence of SEQ ID NO: 32"
GISWNSGSMGYADSVKD

SEQ ID NO: 31 - protein, 18 aa, Homo sapiens
  source: /note="CDR3 sequence of SEQ ID NO: 32"
DKGPGLIGSTADYHGLDV

SEQ ID NO: 32 - protein, 127 aa, Homo sapiens
  source: /note="VH 1.8a"
EVQLVESGGGLVQPGRSLRLSCAASGFTFDDYAMHWVRQAPGKGLEWVSGISWNSGSMGYADSVKDRFTISRDNAKNSLYLQMNSLRAEDTALYYCVKDKGPGLIGSTADYHGLDVWGQGTTVTVSS

SEQ ID NO: 33 - protein, 5 aa, Homo sapiens
  source: /note="CDR1 sequence of SEQ ID NO: 36"
DYAMH

SEQ ID NO: 34 - protein, 17 aa, Homo sapiens
  source: /note="CDR2 sequence of SEQ ID NO: 36"
GISWNGGSMGYAESVKG

SEQ ID NO: 35 - protein, 18 aa, Homo sapiens
  source: /note="CDR3 sequence of SEQ ID NO: 36"
DKGPGLIGSTADYYGMDV

SEQ ID NO: 36 - protein, 127 aa, Homo sapiens
  source: /note="VH 1.9a"
EVQLVESGGGCVQPGRSLRISCAASGFTFDDYAMHWVRQAPGKGREWVSGISWNGGSMGYAESVKGRFTISRDNAKNSLYLQMNSLRAEDSALYYCVKDKGPGLIGSTADYYGMDVWGQGTTVTVSS

SEQ ID NO: 37 - protein, 5 aa, Homo sapiens
  source: /note="CDR1 sequence of SEQ ID NO: 40"
DYAMH

SEQ ID NO: 38 - protein, 17 aa, Homo sapiens
  source: /note="CDR2 sequence of SEQ ID NO: 40"
GISWNGGSMGYAESVKG

SEQ ID NO: 39 - protein, 18 aa, Homo sapiens
  source: /note="CDR3 sequence of SEQ ID NO: 40"
DKGPGLTGTTADYYGMDV

SEQ ID NO: 40 - protein, 127 aa, Homo sapiens
  source: /note="VH 1.10a"
EVQLVESGGGLVQPGRSLRLSCAASGFTFADYAMHWVRQAPGKGREWVSGISWNGGSMGYAESVKGRFTISRDNAKNSLYLQMNSLRAEDSALYYCVKDKGPGLTGTTADYYGMDVWGQGTTVTVSS

SEQ ID NO: 41 - protein, 5 aa, Homo sapiens
  source: /note="CDR1 sequence of SEQ ID NO: 44"
DYAMH

SEQ ID NO: 42 - protein, 17 aa, Homo sapiens
  source: /note="CDR2 sequence of SEQ ID NO: 44"
GISWNGGSMGYAESVKG

SEQ ID NO: 43 - protein, 18 aa, Homo sapiens
  source: /note="CDR3 sequence of SEQ ID NO: 44"
DKGPGLIGSTADYYGLDV

SEQ ID NO: 44 - protein, 127 aa, Homo sapiens
  source: /note="VH 1.11a"
EVQLLESGGGFVQPGRSLRISCAASGFTFDDYAMHWVRQAPGKDLEWVSGISWNGGSMGYAESVKGRFTISRDNAKNSLYLKMNSLRVEDTALYYCVKDKGPGLIGSTADYYGLDVWGQGTTVTVSS

SEQ ID NO: 45 - protein, 5 aa, Homo sapiens
  source: /note="CDR1 sequence of SEQ ID NO: 48"
DYAMH

SEQ ID NO: 46 - protein, 17 aa, Homo sapiens
  source: /note="CDR2 sequence of SEQ ID NO: 48"
GISWNGGSMGYADSVKD

SEQ ID NO: 47 - protein, 18 aa, Homo sapiens
  source: /note="CDR3 sequence of SEQ ID NO: 48"
DKGPGLTGSTADYHGMDV

SEQ ID NO: 48 - protein, 127 aa, Homo sapiens
  source: /note="VH 1.12a"
QVQLVESGGGLVQPGRSLRLSCAASGFTFDDYAMHWVRQAPGKGREWVSGISWNGGSMGYADSVKDRFTISRDNAKNSLYLQMNSLRAEDTALYYCVKDKGPGLTGSTADYHGMDVWGQGTTVTVSS

SEQ ID NO: 49 - protein, 5 aa, Homo sapiens
  source: /note="CDR1 sequence of SEQ ID NO: 52"
DYAMH

SEQ ID NO: 50 - protein, 17 aa, Homo sapiens
  source: /note="CDR2 sequence of SEQ ID NO: 52"
GISWNGGSMGYAASVKG

SEQ ID NO: 51 - protein, 18 aa, Homo sapiens
  source: /note="CDR3 sequence of SEQ ID NO: 52"
DKGPGLIGSTADYYGLDV

SEQ ID NO: 52 - protein, 127 aa, Homo sapiens
  source: /note="VH 1.13a"
QVQLVESGGGLVQPGRSLRLSCAASGFTFDDYAMHWVRQAPGKDLEWVSGISWNGGSMGYAASVKGRFTISRDNAQNSLYLQMNSLRAEDTALYYCVKDKGPGLIGSTADYYGLDVWGQGTTVTVSS

SEQ ID NO: 53 - protein, 5 aa, Homo sapiens
  source: /note="CDR1 sequence of SEQ ID NO: 56"
GYAMH

SEQ ID NO: 54 - protein, 17 aa, Homo sapiens
  source: /note="CDR2 sequence of SEQ ID NO: 56"
GISWNSGSMGYAESVKG

SEQ ID NO: 55 - protein, 18 aa, Homo sapiens
  source: /note="CDR3 sequence of SEQ ID NO: 56"
DKGPGLTGSTADYYGMDV

SEQ ID NO: 56 - protein, 127 aa, Homo sapiens
  source: /note="VH 1.14a"
EVQLVESGGGLVQPGRSLRLSCAASGFTFDGYAMHWVRQAPGKGREWVSGISWNSGSMGYAESVKGRFTISRDNAKNSLYLQMNSLRAEDSALYYCVKDKGPGLTGSTADYYGMDVWGQGTTVTVSS

SEQ ID NO: 57 - protein, 5 aa, Homo sapiens
  source: /note="CDR1 sequence of SEQ ID NO: 60"
DYAMH

SEQ ID NO: 58 - protein, 17 aa, Homo sapiens
  source: /note="CDR2 sequence of SEQ ID NO: 60"
GISWNSGSMGYAESVKG

SEQ ID NO: 59 - protein, 18 aa, Homo sapiens
  source: /note="CDR3 sequence of SEQ ID NO: 60"
DKGPGLIGSTADYYGMDV

SEQ ID NO: 60 - protein, 127 aa, Homo sapiens
  source: /note="VH 1.15a"
EVQLLESGGGLVQPGRSLRLSCTASGFTFDDYAMHWVRQAPGKGREWVSGISWNSGSMGYAESVKGRFTISRDNAKNSLYLQMNSLRAEDSALYYCVKDKGPGLIGSTADYYGMDVWGQGTTVTVSS

SEQ ID NO: 61 - protein, 5 aa, Homo sapiens
  source: /note="CDR1 sequence of SEQ ID NO: 64"
DYAMH

SEQ ID NO: 62 - protein, 17 aa, Homo sapiens
  source: /note="CDR2 sequence of SEQ ID NO: 64"
GISWNGGSMGYAESVKG

SEQ ID NO: 63 - protein, 18 aa, Homo sapiens
  source: /note="CDR3 sequence of SEQ ID NO: 64"
DKGPGLIGSTADYYGMDV

SEQ ID NO: 64 - protein, 127 aa, Homo sapiens
  source: /note="VH 1.16a"
QVQLVESGGGLVQPGRSLRLSCAASGFTFDDYAMHWVRQAPGKGREWVSGISWNGGSMGYAESVKGRFTISRDNAKNSLYLQMNSLRAEDSALYYCVKDKGPGLIGSTADYYGMDVWGQGTTVTVSS

SEQ ID NO: 65 - protein, 5 aa, Homo sapiens
  source: /note="CDR1 sequence of SEQ ID NO: 68"
DYAMH

SEQ ID NO: 66 - protein, 17 aa, Homo sapiens
  source: /note="CDR2 sequence of SEQ ID NO: 68"
GISWNSGSMGYAASVKD

SEQ ID NO: 67 - protein, 18 aa, Homo sapiens
  source: /note="CDR3 sequence of SEQ ID NO: 68"
DKGPGLIGSTADYHGLDV

SEQ ID NO: 68 - protein, 127 aa, Homo sapiens
  source: /note="VH 1.17a"
EVQLLESGGGLVQPGGSLRLSCAASGFTFDDYAMHWVRQAPGKGLEWVSGISWNSGSMGYAASVKDRFTISRDNAKNSLYLQMNSLTTEDTALYYCVKDKGPGLIGSTADYHGLDVWGQGTTVTVSS

SEQ ID NO: 69 - protein, 5 aa, Homo sapiens
  source: /note="CDR1 sequence of SEQ ID NO: 72"
DYAMH

SEQ ID NO: 70 - protein, 17 aa, Homo sapiens
  source: /note="CDR2 sequence of SEQ ID NO: 72"
GISWNGGSMGYAASVKG

SEQ ID NO: 71 - protein, 18 aa, Homo sapiens
  source: /note="CDR3 sequence of SEQ ID NO: 72"
DKGPGLIGSTADYYGLDV

SEQ ID NO: 72 - protein, 127 aa, Homo sapiens
  source: /note="VH 1.18a"
QVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVKDKGPGLIGSTADYYGLDVWGQGTTVTVSS

SEQ ID NO: 73 - protein, 5 aa, Homo sapiens
  source: /note="CDR1 sequence of SEQ ID NO: 76"
DYAMH

SEQ ID NO: 74 - protein, 17 aa, Homo sapiens
  source: /note="CDR2 sequence of SEQ ID NO: 76"
GISWNGGSMGYADSVKG

SEQ ID NO: 75 - protein, 18 aa, Homo sapiens
  source: /note="CDR3 sequence of SEQ ID NO: 76"
EKGPGLTGSTADYYGLDV

SEQ ID NO: 76 - protein, 127 aa, Homo sapiens
  source: /note="VH 1.19a"
EVQLVESGGGLVQPGRSLRLSCAASGFTFDDYAMHWVRQAPGKDLEWVSGISWNGGSMGYADSVKGRFTISRDNAKNSLYLQMNSLRAEDTALYYCVREKGPGLTGSTADYYGLDVWGQGTMVTVSS

SEQ ID NO: 77 - protein, 5 aa, Homo sapiens
  source: /note="CDR1 sequence of SEQ ID NO: 80"
DYAMH

SEQ ID NO: 78 - protein, 17 aa, Homo sapiens
  source: /note="CDR2 sequence of SEQ ID NO: 80"
GISWNGGSMGYADSVKG

SEQ ID NO: 79 - protein, 18 aa, Homo sapiens
  source: /note="CDR3 sequence of SEQ ID NO: 80"
EKGPGLTGSTADYYGLDV

SEQ ID NO: 80 - protein, 127 aa, Homo sapiens; identical to SEQ ID NO: 76
  source: /note="VH 1.20a"

SEQ ID NO: 81 - DNA, 381 bp, Homo sapiens
  source: /note="VH 1.1a"
gaggtgcagctgttggagtctgggggaggctcggtacagcctggcaggtccctgagactctcctgtgcagcctctggattcacctttgacgatcatgccatgcactgggtccggcaagctccagggaagggcctggaatgggtctcaggtattagttggaatagtggcagtatgggctatgcggactctgtgaaggaccgattcaccatctccagagacaacgccaagagctccctgtatctccaaatgaacagtctgagagctgaggacacggccttgtattattgtgtaagagaaaaggggcccggcttaactggaagtacggccgattactacggtttggacgtctggggccaagggaccatggtcaccgtctcttca

SEQ ID NO: 82 - DNA, 381 bp, Homo sapiens
  source: /note="VH 1.2a"
gaggtgcagctggtggagtctgggggaggcttggtacagcctggcaggtccctgagactctcctgtgcagcctctggattcacctttgacgattatgccatgcactgggtccggcaagctccggggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaaaagataaggggcccggcttaattggaagtacggccgattactacggtttggacgtctggggccaagggaccacggtcactgtctcctca

SEQ ID NO: 83 - DNA, 381 bp, Homo sapiens
  source: /note="VH 1.3a"
gaggtgcagctgttggagtctgggggaggcttggtacagcctggcaggtccctgagactctcctgtgcagcctctggattcacctttgacgattatgccatgcactgggtccggcaagctccagggaagggccgggagtgggtctcaggtattagttggaatagtggtagcatgggctatgcggactctgtgaaggaccgcttcaccatctccagagacaacgccaagaactccctgtatctgcaaatgaacagtctgagagcagaggacacggccctgtattattgtgtgaaagataaggggcccggcttaattggaagtacggccgattaccacggtttggacgtctggggccaagggaccacggtcaccgtctcttca

SEQ ID NO: 84 - DNA, 381 bp, Homo sapiens
  source: /note="VH 1.4a"
gaggtgcagctgttggagtctgggggaggcttggtacagcctggcaggtccctgagactctcctgtgcagcctctggattcacctttgccgattatgccatgcactgggtccggcaggctccagggaagggccgggagtgggtctcaggaattagttggaatggtggtagcatgggctatgcggagtctgtgaagggccgattcaccatctccagagacaacgccaagaattccctgtatctgcaaatgaacagtctgagagctgaggactcggccttgtattattgtgtaaaagataaggggcccggcttaactggaactacggccgattactacggtatggacgtctggggccaagggaccacggtcaccgtctcttca

SEQ ID NO: 85 - DNA, 381 bp, Homo sapiens
  source: /note="VH 1.5a"
gaggtgcagctggtggagtctgggggaggcttggtacagcctggcaggtccctgagactctcctgtgcagcctctggattcacctttgacgattatgccatgcactgggtccggcaagctccaggaaagggcctggagtgggtctcaggtattagttggaatggtggttccatgggctatgcggactctgtgaaggaccgcttcaccatctccagagacaacgccaagaactccctgtatctgcaaatgaacagactgagagctgaggacacggccttgtattattgtgtgaaagataaggggcccggcttaattggaagtacggccgattaccacggtttggacgtctggggccaagggaccacggtcactgtctcttca

SEQ ID NO: 86 - DNA, 381 bp, Homo sapiens
  source: /note="VH 1.6a"
gaggtgcagctggtggagtctgggggaggcgtggtccagcctgggaggtccctgagactctcctgtgcagcctctggattcaccttcagtagctatgccatgcactgggtccggcaggctccagggaagggccgggagtgggtctcaggaattagttggaatagtggtagtatgggctatgcggagtctgtgaagggccgattcaccatctccagagacaacgccaagaactccctgtatctgcaaatgaacagtctgagagctgaggactcggccttgtattattgtgtaaaagataaggggcccggcctaactggaactacggccgattattacggtatggacgtctggggccaagggaccacggtcaccgtctcctca

SEQ ID NO: 87 - DNA, 381 bp, Homo sapiens
  source: /note="VH 1.7a"
gaagtgcagctggtggagtctgggggaggcgtgatacagcctggcaggtccctgagactctcctgtgcagcctctggattcacctttgacgattatgccatgcactgggtccggcaggctccagggaagggccgggagtgggtctcaggaattagttggaatggtggtagcatgggctatgcggagtctgtgaagggccgattcaccatctccagagacaacgcccagaattccctgtatctgcaaatgaacagtctgagagctgaggactcggccttgtattattgtgtaaaagataaggggcccggcttaactggaactacggccgattactacggtatggacgtctggggccaagggaccacggtcactgtctcctca

SEQ ID NO: 88 - DNA, 381 bp, Homo sapiens
  source: /note="VH 1.8a"
gaggtgcagctggtggagtctgggggaggcttggtacagcctggcaggtccctgagactctcctgtgcagcctctggattcacctttgacgattatgccatgcactgggtccggcaagctccagggaagggcctggagtgggtctcaggtattagttggaatagtggtagcatgggctatgcggactctgtgaaggaccgcttcaccatctccagagacaacgccaagaactccctgtatctgcaaatgaacagtctgagagctgaggacacggccttgtattattgtgtaaaagataaggggcccggcttaattggaagtacggccgattaccacggtttggacgtctggggccaagggaccacggtcactgtctcctca

SEQ ID NO: 89 - DNA, 381 bp, Homo sapiens
  source: /note="VH 1.9a"
gaagtgcagctggtggagtctgggggaggctgtgtacagcctggcaggtccctgagaatttcctgtgcagcctctggattcacctttgacgattatgccatgcactgggtccggcaggctccagggaagggccgggagtgggtctcaggaattagttggaatggtggtagcatgggctatgcggagtctgttaagggccgattcaccatctccagagacaacgccaagaactccctgtatctacaaatgaacagtctgagagctgaggactcggccttgtattattgtgtaaaagataaggggcccggcttaattggaagtacggccgattactacggtatggacgtctggggccaagggaccacggtcaccgtctcctca

SEQ ID NO: 90 - DNA, 381 bp, Homo sapiens
  source: /note="VH 1.10a"
  modified_base (226)..(226): a, c, t, g, unknown or other
gaggtgcagctgttggagtctgggggaggctcggtacagcctggcaggtccctgagactctcctgtgcagcctctggattcacctttgacgatcatgccatgcactgggtccggcaagctccagggaagggcctggaatgggtctcaggtattagttggaatagtggcagtatgggctatgcggactctgtgaaggaccgattcaccatctccagagacaacgccnagagctccctgtatctccaaatgaacagtctgagagctgaggacacggccttgtattattgtgtaagagaaaaggggcccggcttaactggaagtacggccgattactacggtttggacgtctggggccaagggaccatggtcaccgtctcttca

SEQ ID NO: 91 - DNA, 381 bp, Homo sapiens
  source: /note="VH 1.11a"
gaggtgcagctgttggagtctgggggaggctttgtacagcctggcaggtccctgagaatttcctgtgcagcctctggattcacctttgacgattatgccatgcactgggtccggcaagctccagggaaggacctggagtgggtctcaggtattagttggaatggtggtagcatgggctatgcggagtctgtgaagggccgattcaccatctccagagacaacgccaagaattccctatatctgaaaatgaacagtctgagagttgaggacacggccttgtattattgtgtaaaagataaggggcccgggttaattggaagtacggccgattactacggtttggacgtctggggccaagggaccacggtcactgtctcttca

SEQ ID NO: 92 - DNA, 381 bp, Homo sapiens
  source: /note="VH 1.12a"
caggtgcagctggtggagtctgggggaggcttggtacagcctggcaggtccctgagactctcctgtgcagcctctggattcacctttgacgactatgccatgcactgggtccggcaggctccagggaagggccgggagtgggtctcaggaattagttggaatggtggtagcatgggctatgcggactctgtgaaggaccgcttcaccatctccagagacaacgccaagaactcactatatctgcaaatgaacagtctgagagctgaggacacggccttgtattattgtgtgaaagataaggggcccggcttaactggaagtacggccgattaccacggtatggacgtctggggccaagggaccacggtcaccgtctcctca

SEQ ID NO: 93 - DNA, 381 bp, Homo sapiens
  source: /note="VH 1.13a"
caggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggcctctgtgaagggccgattcaccatctccagagacaacgcccagaactccctgtatctgcaaatgaacagtctgagagctgaggacacggccttgtattattgtgtaaaagataaggggcccggcttaattggaagtacggccgattactacggtttggacgtctggggccaagggaccacggtcactgtctcttca

SEQ ID NO: 94 - DNA, 381 bp, Homo sapiens
  source: /note="VH 1.14a"
gaggtgcagctggtggagtctgggggaggcttggtacagcctggcaggtccctgagactctcctgtgcagcctctggattcacctttgacggttatgccatgcactgggtccggcaggctccagggaagggccgggagtgggtctcaggaattagttggaatagtggtagcatgggctatgcggagtctgtgaagggccgattcaccatctccagagacaacgccaagaactccctgtatctgcaaatgaacagtctgagagctgaggactcggccttgtattattgtgtaaaagataaggggcccggcttaactggaagtacggccgattactacggtatggacgtctggggccaagggaccacggtcaccgtctcctca

SEQ ID NO: 95 - DNA, 381 bp, Homo sapiens
  source: /note="VH 1.15a"
gaggtgcagctgttggagtctgggggaggcttggtacagcctggcaggtccctgagactctcctgtacagcctctggattcacctttgacgattatgccatgcactgggtccggcaggctccagggaagggccgggagtgggtctcaggaattagttggaatagtggtagcatgggctatgcggagtctgtgaagggccgattcaccatctccagagacaacgccaagaactccctgtatctgcaaatgaacagtctgagagctgaggactcggccttgtattattgtgtaaaagataaggggcccggcttaattggaagtacggccgattactacggtatggacgtctggggccaagggaccacggtcaccgtctcctca

SEQ ID NO: 96 - DNA, 381 bp, Homo sapiens
  source: /note="VH 1.16a"
caggtgcagctggtggagtctgggggaggcttggtacagcctggcaggtccctgagactctcctgtgcagcctctggattcacctttgacgactatgccatgcactgggtccggcaggctccagggaagggccgggagtgggtctcaggaattagttggaatggtggtagcatgggctatgcggagtctgttaagggccgattcaccatctccagagacaacgccaagaactccctgtatctacaaatgaacagtctgagagctgaggactcggccttgtattattgtgtaaaagataaggggcccggcttaattggaagtacggccgattactacggtatggacgtctggggccaagggaccacggtcactgtctcctca

SEQ ID NO: 97 - DNA, 381 bp, Homo sapiens
  source: /note="VH 1.17a"
gaggtgcagctgttggagtctgggggaggcttggtccagcctggggggtccctgagactctcctgtgcagcctctggattcacctttgacgattatgccatgcactgggtccggcaagctccagggaagggcctggagtgggtctcaggtattagttggaatagtggtagcatgggctatgcggcctctgtgaaggaccgcttcaccatctccagagacaacgccaagaactccctgtatctgcaaatgaacagtctgacaactgaggacacggccttgtattattgtgtgaaagataaggggcccggcttaattggaagtacggccgattatcacggtttggacgtctggggccaagggaccacggtcactgtctcctca

SEQ ID NO: 98 - DNA, 381 bp, Homo sapiens
  source: /note="VH 1.18a"
caggtgcagctggtggagtctgggggaggccttgtacagcctggcaggtccctgagactttcctgtgcagcctctggattcacctttgacgattatgccatgcactgggtccggcaagctccagggaaggacctggagtgggtctcaggtattagttggaatggtggtagcatgggctatgcggcgtctgtgaagggccgattcaccatctccagagacaacgccaagaattccctatatctgcaaatgaacagtctgagagctgaggacacggccttgtattattgtgtaaaagataaggggcccgggttaattggaagtacggccgattactacggtttggacgtctggggccaagggaccacggtcactgtctcttca

SEQ ID NO: 99 - DNA, 381 bp, Homo sapiens; identical to SEQ ID NO: 98
  source: /note="VH 1.19a"

SEQ ID NO: 100 - DNA, 381 bp, Homo sapiens
  source: /note="VH 1.20a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgtctggggccaagggaccatggtcaccgtctcctca

SEQ ID NO: 101 - protein, 5 aa, Homo sapiens
  source: /note="CDR1 sequence of SEQ ID NO: 104"
DYAMH

SEQ ID NO: 102 - protein, 17 aa, Homo sapiens
  source: /note="CDR2 sequence of SEQ ID NO: 104"
GISWNGGSMGYAASVKG

SEQ ID NO: 103 - protein, 18 aa, Homo sapiens
  source: /note="CDR3 sequence of SEQ ID NO: 104"
EKGPGLTGSTADYYGLDV

SEQ ID NO: 104 - protein, 127 aa, Homo sapiens
  source: /note="VH 1.21a"
EVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVREKGPGLTGSTADYYGLDVWGQGTMVTVSS

SEQ ID NO: 105 - protein, 5 aa, Homo sapiens
  source: /note="CDR1 sequence of SEQ ID NO: 108"
DYAMH

SEQ ID NO: 106 - protein, 17 aa, Homo sapiens
  source: /note="CDR2 sequence of SEQ ID NO: 108"
GISWNGGSMGYAASVKG

SEQ ID NO: 107 - protein, 18 aa, Homo sapiens
  source: /note="CDR3 sequence of SEQ ID NO: 108"
EKGPGLTGSTADYYGLDA

SEQ ID NO: 108 - protein, 127 aa, Homo sapiens
  source: /note="VH 1.22a"
EVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVREKGPGLTGSTADYYGLDAWGQGTMVTVSS

SEQ ID NO: 109 - protein, 5 aa, Homo sapiens
  source: /note="CDR1 sequence of SEQ ID NO: 112"
DYAMH

SEQ ID NO: 110 - protein, 17 aa, Homo sapiens
  source: /note="CDR2 sequence of SEQ ID NO: 112"
GISWNSGSMGYAASVKG

SEQ ID NO: 111 - protein, 18 aa, Homo sapiens
  source: /note="CDR3 sequence of SEQ ID NO: 112"
EKGPGLTGSTADYYGLDV

SEQ ID NO: 112 - protein, 127 aa, Homo sapiens
  source: /note="VH 1.23a"
EVQLVESGGGLVQPGRSLRLSCAASGFTFDDYAMHWVRQAPGKDLEWVSGISWNSGSMGYAASVKGRFTISRDNAKNSLYLQMNSLRAEDTALYYCVREKGPGLTGSTADYYGLDVWGQGTMVTVSS

SEQ ID NO: 113 - protein, 5 aa, Homo sapiens
  source: /note="CDR1 sequence of SEQ ID NO: 116"
DYAMH

SEQ ID NO: 114 - protein, 17 aa, Homo sapiens
  source: /note="CDR2 sequence of SEQ ID NO: 116"
GISWNSGSMGYAASVKG

SEQ ID NO: 115 - protein, 18 aa, Homo sapiens
  source: /note="CDR3 sequence of SEQ ID NO: 116"
EKGPGLTGSTADYYGLDA

SEQ ID NO: 116 - protein, 127 aa, Homo sapiens
  source: /note="VH 1.24a"
EVQLVESGGGLVQPGRSLRLSCAASGFTFDDYAMHWVRQAPGKDLEWVSGISWNSGSMGYAASVKGRFTISRDNAKNSLYLQMNSLRAEDTALYYCVREKGPGLTGSTADYYGLDAWGQGTMVTVSS

SEQ ID NO: 117 - protein, 5 aa, Homo sapiens
  source: /note="CDR1 sequence of SEQ ID NO: 120"
DYAMH

SEQ ID NO: 118 - protein, 17 aa, Homo sapiens
  source: /note="CDR2 sequence of SEQ ID NO: 120"
GISWNGGSQGYAASVKG

SEQ ID NO: 119 - protein, 18 aa, Homo sapiens
  source: /note="CDR3 sequence of SEQ ID NO: 120"
EKGPGLTGSTADYYGLDA

SEQ ID NO: 120 - protein, 127 aa, Homo sapiens
  source: /note="VH 1.25a"
EVQLVESGGGLVQPGRSLRLSCAASGFTFDDYAMHWVRQAPGKDLEWVSGISWNGGSQGYAASVKGRFTISRDNAKNSLYLQMNSLRAEDTALYYCVREKGPGLTGSTADYYGLDAWGQGTMVTVSS

SEQ ID NO: 121 - protein, 5 aa, Homo sapiens
  source: /note="CDR1 sequence of SEQ ID NO: 124"
DYAMH

SEQ ID NO: 122 - protein, 17 aa, Homo sapiens
  source: /note="CDR2 sequence of SEQ ID NO: 124"
GISWNGGSMGYADSVKG

SEQ ID NO: 123 - protein, 18 aa, Homo sapiens
  source: /note="CDR3 sequence of SEQ ID NO: 124"
EKGPGLTGSTADYYGLDA

SEQ ID NO: 124 - protein, 127 aa, Homo sapiens
  source: /note="VH 1.26a"
EVQLVESGGGLVQPGRSLRLSCAASGFTFDDYAMHWVRQAPGKDLEWVSGISWNGGSMGYADSVKGRFTISRDNAKNSLYLQMNSLRAEDTALYYCVREKGPGLTGSTADYYGLDAWGQGTMVTVSS

SEQ ID NO: 125 - protein, 5 aa, Homo sapiens
  source: /note="CDR1 sequence of SEQ ID NO: 128"
DYAMH

SEQ ID NO: 126 - protein, 17 aa, Homo sapiens
  source: /note="CDR2 sequence of SEQ ID NO: 128"
GISWNGGSRGYAASVKG

SEQ ID NO: 127 - protein, 18 aa, Homo sapiens
  source: /note="CDR3 sequence of SEQ ID NO: 128"
EKGPGLTGSTADYYGLDA

SEQ ID NO: 128 - protein, 127 aa, Homo sapiens
  source: /note="VH 1.27a"
EVQLVESGGGLVQPGRSLRLSCAASGFTFDDYAMHWVRQAPGKDLEWVSGISWNGGSRGYAASVKGRFTISRDNAKNSLYLQMNSLRAEDTALYYCVREKGPGLTGSTADYYGLDAWGQGTMVTVSS

SEQ ID NO: 129 - protein, 5 aa, Homo sapiens
  source: /note="CDR1 sequence of SEQ ID NO: 132"
DYAMH

SEQ ID NO: 130 - protein, 17 aa, Homo sapiens
  source: /note="CDR2 sequence of SEQ ID NO: 132"
GISWNAGSMGYAASVKG

SEQ ID NO: 131 - protein, 18 aa, Homo sapiens
  source: /note="CDR3 sequence of SEQ ID NO: 132"
EKGPGLTGSTADYYGLDA

SEQ ID NO: 132 - protein, 127 aa, Homo sapiens
  source: /note="VH 1.28a"
EVQLVESGGGLVQPGRSLRLSCAASGFTFDDYAMHWVRQAPGKDLEWVSGISWNAGSMGYAASVKGRFTISRDNAKNSLYLQMNSLRAEDTALYYCVREKGPGLTGSTADYYGLDAWGQGTMVTVSS

SEQ ID NO: 133 - protein, 5 aa, Homo sapiens
  source: /note="CDR1 sequence of SEQ ID NO: 136"
DYAMH

SEQ ID NO: 134 - protein, 17 aa, Homo sapiens
  source: /note="CDR2 sequence of SEQ ID NO: 136"
GISWNSGSMGYADSVKG

SEQ ID NO: 135 - protein, 18 aa, Homo sapiens
  source: /note="CDR3 sequence of SEQ ID NO: 136"
EKGPGLTGSTADYYGLDV

SEQ ID NO: 136 - protein, 127 aa, Homo sapiens
  source: /note="VH 1.29a"
EVQLVESGGGLVQPGRSLRLSCAASGFTFDDYAMHWVRQAPGKDLEWVSGISWNSGSMGYADSVKGRFTISRDNAKNSLYLQMNSLRAEDTALYYCVREKGPGLTGSTADYYGLDVWGQGTMVTVSS

SEQ ID NO: 137 - protein, 5 aa, Homo sapiens
  source: /note="CDR1 sequence of SEQ ID NO: 140"
DYAGH

SEQ ID NO: 138 - protein, 17 aa, Homo sapiens
  source: /note="CDR2 sequence of SEQ ID NO: 140"
GISWNGGSMGYAASVKG

SEQ ID NO: 139 - protein, 18 aa, Homo sapiens
  source: /note="CDR3 sequence of SEQ ID NO: 140"
EKGPGLTGSTADYYGLDA

SEQ ID NO: 140 - protein, 127 aa, Homo sapiens
  source: /note="VH 1.30a"
EVQLVESGGGLVQPGRSLRLSCAASGFTFDDYAGHWVRQAPGKDLEWVSGISWNGGSMGYAASVKGRFTISRDNAKNSLYLQMNSLRAEDTALYYCVREKGPGLTGSTADYYGLDAWGQGTMVTVSS

SEQ ID NO: 141 - protein, 5 aa, Homo sapiens
  source: /note="CDR1 sequence of SEQ ID NO: 144"
DYALH

SEQ ID NO: 142 - protein, 17 aa, Homo sapiens
  source: /note="CDR2 sequence of SEQ ID NO: 144"
GISWNGGSMGYAASVKG

SEQ ID NO: 143 - protein, 18 aa, Homo sapiens
  source: /note="CDR3 sequence of SEQ ID NO: 144"
EKGPGLTGSTADYYGLDA

SEQ ID NO: 144 - protein, 127 aa, Homo sapiens
  source: /note="VH 1.31a"
EVQLVESGGGLVQPGRSLRLSCAASGFTFDDYALHWVRQAPGKDLEWVSGISWNGGSMGYAASVKGRFTISRDNAKNSLYLQMNSLRAEDTALYYCVREKGPGLTGSTADYYGLDAWGQGTMVTVSS

SEQ ID NO: 145 - protein, 5 aa, Homo sapiens
  source: /note="CDR1 sequence of SEQ ID NO: 148"
DYAMH

SEQ ID NO: 146 - protein, 17 aa, Homo sapiens
  source: /note="CDR2 sequence of SEQ ID NO: 148"
GISWNSGSMGYADSVKG

SEQ ID NO: 147 - protein, 18 aa, Homo sapiens
  source: /note="CDR3 sequence of SEQ ID NO: 148"
EKGPGLTGSTADYYGLDA

SEQ ID NO: 148 - protein, 127 aa, Homo sapiens
  source: /note="VH 1.32a"
EVQLVESGGGLVQPGRSLRLSCAASGFTFDDYAMHWVRQAPGKDLEWVSGISWNSGSMGYADSVKGRFTISRDNAKNSLYLQMNSLRAEDTALYYCVREKGPGLTGSTADYYGLDAWGQGTMVTVSS

SEQ ID NO: 149 - protein, 5 aa, Homo sapiens
  source: /note="CDR1 sequence of SEQ ID NO: 152"
DYAMH

SEQ ID NO: 150 - protein, 17 aa, Homo sapiens
  source: /note="CDR2 sequence of SEQ ID NO: 152"
GISWNGGSYGYADSVKG

SEQ ID NO: 151 - protein, 18 aa, Homo sapiens
  source: /note="CDR3 sequence of SEQ ID NO: 152"
EKGPGLTGSTADYYGLDA

SEQ ID NO: 152 - protein, 127 aa, Homo sapiens
  source: /note="VH 1.33a"
EVQLVESGGGLVQPGRSLRLSCAASGFTFDDYAMHWVRQAPGKDLEWVSGISWNGGSYGYADSVKGRFTISRDNAKNSLYLQMNSLRAEDTALYYCVREKGPGLTGSTADYYGLDAWGQGTMVTVSS

SEQ ID NO: 153 - protein, 5 aa, Homo sapiens
  source: /note="CDR1 sequence of SEQ ID NO: 156"
DYAMH

SEQ ID NO: 154 - protein, 17 aa, Homo sapiens
  source: /note="CDR2 sequence of SEQ ID NO: 156"
GISWNGGSQGYADSVKG

SEQ ID NO: 155 - protein, 18 aa, Homo sapiens
  source: /note="CDR3 sequence of SEQ ID NO: 156"
EKGPGLTGSTADYYGLDA

SEQ ID NO: 156 - protein, 127 aa, Homo sapiens
  source: /note="VH 1.34a"
EVQLVESGGGLVQPGRSLRLSCAASGFTFDDYAMHWVRQAPGKDLEWVSGISWNGGSQGYADSVKGRFTISRDNAKNSLYLQMNSLRAEDTALYYCVREKGPGLTGSTADYYGLDAWGQGTMVTVSS

SEQ ID NO: 157 - protein, 5 aa, Homo sapiens
  source: /note="CDR1 sequence of SEQ ID NO: 160"
DYAMH

SEQ ID NO: 158 - protein, 17 aa, Homo sapiens
  source: /note="CDR2 sequence of SEQ ID NO: 160"
GISWNGGSKGYADSVKG

SEQ ID NO: 159 - protein, 18 aa, Homo sapiens
  source: /note="CDR3 sequence of SEQ ID NO: 160"
EKGPGLTGSTADYYGLDA

SEQ ID NO: 160 - protein, 127 aa, Homo sapiens
  source: /note="VH 1.35a"
EVQLVESGGGLVQPGRSLRLSCAASGFTFDDYAMHWVRQAPGKDLEWVSGISWNGGSKGYADSVKGRFTISRDNAKNSLYLQMNSLRAEDTALYYCVREKGPGLTGSTADYYGLDAWGQGTMVTVSS

SEQ ID NO: 161 - protein, 5 aa, Homo sapiens
  source: /note="CDR1 sequence of SEQ ID NO: 164"
DYAMH

SEQ ID NO: 162 - protein, 17 aa, Homo sapiens
  source: /note="CDR2 sequence of SEQ ID NO: 164"
GISWNAGSMGYADSVKG

SEQ ID NO: 163 - protein, 18 aa, Homo sapiens
  source: /note="CDR3 sequence of SEQ ID NO: 164"
EKGPGLTGSTADYYGLDA

SEQ ID NO: 164 - protein, 127 aa, Homo sapiens
  source: /note="VH 1.36a"
EVQLVESGGGLVQPGRSLRLSCAASGFTFDDYAMHWVRQAPGKDLEWVSGISWNAGSMGYADSVKGRFTISRDNAKNSLYLQMNSLRAEDTALYYCVREKGPGLTGSTADYYGLDAWGQGTMVTVSS

SEQ ID NO: 165 - protein, 5 aa, Homo sapiens
  source: /note="CDR1 sequence of SEQ ID NO: 168"
DYAFH

SEQ ID NO: 166 - protein, 17 aa, Homo sapiens
  source: /note="CDR2 sequence of SEQ ID NO: 168"
GISWNGGSMGYADSVKG

SEQ ID NO: 167 - protein, 18 aa, Homo sapiens
  source: /note="CDR3 sequence of SEQ ID NO: 168"
EKGPGLTGSTADYYGLDA

SEQ ID NO: 168 - protein, 127 aa, Homo sapiens
  source: /note="VH 1.37a"
EVQLVESGGGLVQPGRSLRLSCAASGFTFDDYAFHWVRQAPGKDLEWVSGISWNGGSMGYADSVKGRFTISRDNAKNSLYLQMNSLRAEDTALYYCVREKGPGLTGSTADYYGLDAWGQGTMVTVSS

SEQ ID NO: 169 - protein, 5 aa, Homo sapiens
  source: /note="CDR1 sequence of SEQ ID NO: 172"
DYALH

SEQ ID NO: 170 - protein, 17 aa, Homo sapiens
  source: /note="CDR2 sequence of SEQ ID NO: 172"
GISWNGGSMGYADSVKG

SEQ ID NO: 171 - protein, 18 aa, Homo sapiens
  source: /note="CDR3 sequence of SEQ ID NO: 172"
EKGPGLTGSTADYYGLDA

SEQ ID NO: 172 - protein, 127 aa, Homo sapiens
  source: /note="VH 1.38a"
EVQLVESGGGLVQPGRSLRLSCAASGFTFDDYALHWVRQAPGKDLEWVSGISWNGGSMGYADSVKGRFTISRDNAKNSLYLQMNSLRAEDTALYYCVREKGPGLTGSTADYYGLDAWGQGTMVTVSS

SEQ ID NO: 173 - protein, 5 aa, Homo sapiens
  source: /note="CDR1 sequence of SEQ ID NO: 176"
DYALH

SEQ ID NO: 174 - protein, 17 aa, Homo sapiens
  source: /note="CDR2 sequence of SEQ ID NO: 176"
GISWNGGSYGYADSVKG

SEQ ID NO: 175 - protein, 18 aa, Homo sapiens
  source: /note="CDR3 sequence of SEQ ID NO: 176"
EKGPGLTGSTADYYGLDA

SEQ ID NO: 176 - protein, 127 aa, Homo sapiens
  source: /note="VH 1.39a"
EVQLVESGGGLVQPGRSLRLSCAASGFTFDDYALHWVRQAPGKDLEWVSGISWNGGSYGYADSVKGRFTISRDNAKNSLYLQMNSLRAEDTALYYCVREKGPGLTGSTADYYGLDAWGQGTMVTVSS

SEQ ID NO: 177 - protein, 5 aa, Homo sapiens
  source: /note="CDR1 sequence of SEQ ID NO: 180"
DYALH

SEQ ID NO: 178 - protein, 17 aa, Homo sapiens
  source: /note="CDR2 sequence of SEQ ID NO: 180"
GISWNGGSQGYADSVKG

SEQ ID NO: 179 - protein, 18 aa, Homo sapiens
  source: /note="CDR3 sequence of SEQ ID NO: 180"
EKGPGLTGSTADYYGLDA

SEQ ID NO: 180 - protein, 127 aa, Homo sapiens
  source: /note="VH 1.40a"
EVQLVESGGGLVQPGRSLRLSCAASGFTFDDYALHWVRQAPGKDLEWVSGISWNGGSQGYADSVKGRFTISRDNAKNSLYLQMNSLRAEDTALYYCVREKGPGLTGSTADYYGLDAWGQGTMVTVSS

SEQ ID NO: 181 - protein, 5 aa, Homo sapiens
  source: /note="CDR1 sequence of SEQ ID NO: 184"
DYAFH

SEQ ID NO: 182 - protein, 17 aa, Homo sapiens
  source: /note="CDR2 sequence of SEQ ID NO: 184"
GISWNGGSYGYADSVKG

SEQ ID NO: 183 - protein, 18 aa, Homo sapiens
  source: /note="CDR3 sequence of SEQ ID NO: 184"
EKGPGLTGSTADYYGLDA

SEQ ID NO: 184 - protein, 127 aa, Homo sapiens
  source: /note="VH 1.41a"
EVQLVESGGGLVQPGRSLRLSCAASGFTFDDYAFHWVRQAPGKDLEWVSGISWNGGSYGYADSVKGRFTISRDNAKNSLYLQMNSLRAEDTALYYCVREKGPGLTGSTADYYGLDAWGQGTMVTVSS

SEQ ID NO: 185 - protein, 5 aa, Homo sapiens
  source: /note="CDR1 sequence of SEQ ID NO: 188"
DYAFH

SEQ ID NO: 186 - protein, 17 aa, Homo sapiens
  source: /note="CDR2 sequence of SEQ ID NO: 188"
GISWNGGSQGYADSVKG

SEQ ID NO: 187 - protein, 18 aa, Homo sapiens
  source: /note="CDR3 sequence of SEQ ID NO: 188"
EKGPGLTGSTADYYGLDA

SEQ ID NO: 188 - protein, 127 aa, Homo sapiens
  source: /note="VH 1.42a"
EVQLVESGGGLVQPGRSLRLSCAASGFTFDDYAFHWVRQAPGKDLEWVSGISWNGGSQGYADSVKGRFTISRDNAKNSLYLQMNSLRAEDTALYYCVREKGPGLTGSTADYYGLDAWGQGTMVTVSS

SEQ ID NO: 189 - protein, 5 aa, Homo sapiens
  source: /note="CDR1 sequence of SEQ ID NO: 192"
DYAFH

SEQ ID NO: 190 - protein, 17 aa, Homo sapiens
  source: /note="CDR2 sequence of SEQ ID NO: 192"
GISWNAGSYGYADSVKG

SEQ ID NO: 191 - protein, 18 aa, Homo sapiens
  source: /note="CDR3 sequence of SEQ ID NO: 192"
EKGPGLTGSTADYYGLDA

SEQ ID NO: 192 - protein, 127 aa, Homo sapiens
  source: /note="VH 1.43a"
EVQLVESGGGLVQPGRSLRLSCAASGFTFDDYAFHWVRQAPGKDLEWVSGISWNAGSYGYADSVKGRFTISRDNAKNSLYLQMNSLRAEDTALYYCVREKGPGLTGSTADYYGLDAWGQGTMVTVSS

SEQ ID NO: 193 - protein, 5 aa, Homo sapiens
  source: /note="CDR1 sequence of SEQ ID NO: 196"
DYALH

SEQ ID NO: 194 - protein, 17 aa, Homo sapiens
  source: /note="CDR2 sequence of SEQ ID NO: 196"
GISWNSGSYGYADSVKG

SEQ ID NO: 195 - protein, 18 aa, Homo sapiens
  source: /note="CDR3 sequence of SEQ ID NO: 196"
EKGPGLTGSTADYYGLDA

SEQ ID NO: 196 - protein, 127 aa, Homo sapiens
  source: /note="VH 1.44a"
EVQLVESGGGLVQPGRSLRLSCAASGFTFDDYALHWVRQAPGKDLEWVSGISWNSGSYGYADSVKGRFTISRDNAKNSLYLQMNSLRAEDTALYYCVREKGPGLTGSTADYYGLDAWGQGTMVTVSS

SEQ ID NO: 197 - protein, 5 aa, Homo sapiens
  source: /note="CDR1 sequence of SEQ ID NO: 200"
DYALH

SEQ ID NO: 198 - protein, 17 aa, Homo sapiens
  source: /note="CDR2 sequence of SEQ ID NO: 200"
GISWNAGSQGYADSVKG

SEQ ID NO: 199 - protein, 18 aa, Homo sapiens
  source: /note="CDR3 sequence of SEQ ID NO: 200"
EKGPGLTGSTADYYGLDA

SEQ ID NO: 200 - protein, 127 aa, Homo sapiens
  source: /note="VH 1.45a"
EVQLVESGGGLVQPGRSLRLSCAASGFTFDDYALHWVRQAPGKDLEWVSGISWNAGSQGYADSVKGRFTISRDNAKNSLYLQMNSLRAEDTALYYCVREKGPGLTGSTADYYGLDAWGQGTMVTVSS

SEQ ID NO: 201 - protein, 5 aa, Homo sapiens
  source: /note="CDR1 sequence of SEQ ID NO: 204"
DYALH

SEQ ID NO: 202 - protein, 17 aa, Homo sapiens
  source: /note="CDR2 sequence of SEQ ID NO: 204"
GISWNAGSYGYADSVKG

SEQ ID NO: 203 - protein, 18 aa, Homo sapiens
  source: /note="CDR3 sequence of SEQ ID NO: 204"
EKGPGLTGSTADYYGLDA

SEQ ID NO: 204 - protein, 127 aa, Homo sapiens
  source: /note="VH 1.46a"
EVQLVESGGGLVQPGRSLRLSCAASGFTFDDYALHWVRQAPGKDLEWVSGISWNAGSYGYADSVKGRFTISRDNAKNSLYLQMNSLRAEDTALYYCVREKGPGLTGSTADYYGLDAWGQGTMVTVSS

SEQ ID NO: 205 - protein, 5 aa, Homo sapiens
  source: /note="CDR1 sequence of SEQ ID NO: 208"
DYAFH

SEQ ID NO: 206 - protein, 17 aa, Homo sapiens
  source: /note="CDR2 sequence of SEQ ID NO: 208"
GISWNSGSYGYADSVKG

SEQ ID NO: 207 - protein, 18 aa, Homo sapiens
  source: /note="CDR3 sequence of SEQ ID NO: 208"
EKGPGLTGSTADYYGLDA

SEQ ID NO: 208 - protein, 127 aa, Homo sapiens
  source: /note="VH 1.47a"
EVQLVESGGGLVQPGRSLRLSCAASGFTFDDYAFHWVRQAPGKDLEWVSGISWNSGSYGYADSVKGRFTISRDNAKNSLYLQMNSLRAEDTALYYCVREKGPGLTGSTADYYGLDAWGQGTMVTVSS

SEQ ID NO: 209 - protein, 5 aa, Homo sapiens
  source: /note="CDR1 sequence of SEQ ID NO: 212"
DYALH

SEQ ID NO: 210 - protein, 17 aa, Homo sapiens
  source: /note="CDR2 sequence of SEQ ID NO: 212"
GISWNSGSQGYADSVKG

SEQ ID NO: 211 - protein, 18 aa, Homo sapiens
  source: /note="CDR3 sequence of SEQ ID NO: 212"
EKGPGLTGSTADYYGLDA

SEQ ID NO: 212 - protein, 127 aa, Homo sapiens
  source: /note="VH 1.48a"
EVQLVESGGGLVQPGRSLRLSCAASGFTFDDYALHWVRQAPGKDLEWVSGISWNSGSQGYADSVKGRFTISRDNAKNSLYLQMNSLRAEDTALYYCVREKGPGLTGSTADYYGLDAWGQGTMVTVSS

SEQ ID NO: 213 - protein, 5 aa, Homo sapiens
  source: /note="CDR1 sequence of SEQ ID NO: 216"
DYAFH

SEQ ID NO: 214 - protein, 17 aa, Homo sapiens
  source: /note="CDR2 sequence of SEQ ID NO: 216"
GISWNSGSQGYADSVKG

SEQ ID NO: 215 - protein, 18 aa, Homo sapiens
  source: /note="CDR3 sequence of SEQ ID NO: 216"
EKGPGLTGSTADYYGLDA

SEQ ID NO: 216 - protein, 127 aa, Homo sapiens
  source: /note="VH 1.49a"
EVQLVESGGGLVQPGRSLRLSCAASGFTFDDYAFHWVRQAPGKDLEWVSGISWNSGSQGYADSVKGRFTISRDNAKNSLYLQMNSLRAEDTALYYCVREKGPGLTGSTADYYGLDAWGQGTMVTVSS

SEQ ID NO: 217 - protein, 5 aa, Homo sapiens
  source: /note="CDR1 sequence of SEQ ID NO: 220"
DYAFH

SEQ ID NO: 218 - protein, 17 aa, Homo sapiens
  source: /note="CDR2 sequence of SEQ ID NO: 220"
GISWNAGSQGYADSVKG

SEQ ID NO: 219 - protein, 18 aa, Homo sapiens
  source: /note="CDR3 sequence of SEQ ID NO: 220"
EKGPGLTGSTADYYGLDA

SEQ ID NO: 220 - protein, 127 aa, Homo sapiens
  source: /note="VH 1.50a"
EVQLVESGGGLVQPGRSLRLSCAASGFTFDDYAFHWVRQAPGKDLEWVSGISWNAGSQGYADSVKGRFTISRDNAKNSLYLQMNSLRAEDTALYYCVREKGPGLTGSTADYYGLDAWGQGTMVTVSS

SEQ ID NO: 221 - DNA, 381 bp, Homo sapiens
  source: /note="VH 1.21a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgtctggggccaagggaccatggtcaccgtctcctca

SEQ ID NO: 222 - DNA, 381 bp, Homo sapiens
  source: /note="VH 1.22a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 223 - DNA, 381 bp, Homo sapiens
  source: /note="VH 1.23a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatagtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgtctggggccaagggaccatggtcaccgtctcctca

SEQ ID NO: 224 - DNA, 381 bp, Homo sapiens
  source: /note="VH 1.24a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatagtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 225 - DNA, 381 bp, Homo sapiens
  source: /note="VH 1.25a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagccagggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 226 - DNA, 381 bp, Homo sapiens
  source: /note="VH 1.26a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 227 - DNA, 381 bp, Homo sapiens
  source: /note="VH 1.27a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcaggggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 228 - DNA, 381 bp, Homo sapiens
  source: /note="VH 1.28a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatgcgggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 229 - DNA, 381 bp, Homo sapiens
  source: /note="VH 1.29a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatagtggtagcatgggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgtctggggccaagggaccatggtcaccgtctcctca

SEQ ID NO: 230 - DNA, 381 bp, Homo sapiens
  source: /note="VH 1.30a"
gaggtgcagctggtggagtctgggggaggcttggtacagcctggcaggtccctgagactctcctgtgcagcctctggattcacctttgacgattatgccgggcactgggtccggcaagctccagggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 231 - DNA, 381 bp, Homo sapiens
  source: /note="VH 1.31a"
gaggtgcagctggtggagtctgggggaggcttggtacagcctggcaggtccctgagactctcctgtgcagcctctggattcacctttgacgattatgccttgcactgggtccggcaagctccagggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 232 - DNA, 381 bp, Homo sapiens
  source: /note="VH 1.32a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatagtggtagcatgggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 233 - DNA, 381 bp, Homo sapiens
  source: /note="VH 1.33a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagctacggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 234 - DNA, 381 bp, Homo sapiens
  source: /note="VH 1.34a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagccagggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 235 - DNA, 381 bp, Homo sapiens
  source: /note="VH 1.35a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcaagggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 236 - DNA, 381 bp, Homo sapiens
  source: /note="VH 1.36a"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatgcgggtagcatgggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 237 - DNA, 381 bp, Homo sapiens
  source: /note="VH 1.37a"
gaggtgcagctggtggagtctgggggaggcttggtacagcctggcaggtccctgagactctcctgtgcagcctctggattcacctttgacgattatgccttccactgggtccggcaagctccagggaaggacctggagtgggtctcaggtattagttggaatggtggtagcatgggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 238 - DNA, 381 bp, Homo sapiens
  source: /note="VH 1.38a"
gaggtgcagctggtggagtctgggggaggcttggtacagcctggcaggtccctgagactctcctgtgcagcctctggattcacctttgacgattatgccctccactgggtccggcaagctccagggaaggacctggagtgggtctcaggtattagttggaatggtggtagcatgggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 239 - DNA, 381 bp, Homo sapiens
  source: /note="VH 1.39a"
gaggtgcagctggtggagtctgggggaggcttggtacagcctggcaggtccctgagactctcctgtgcagcctctggattcacctttgacgattatgccctacactgggtccggcaagctccagggaaggacctggagtgggtctcaggtattagttggaatggtggtagctacggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 240 - DNA, 381 bp, Homo sapiens
  source: /note="VH 1.40a"
gaggtgcagctggtggagtctgggggaggcttggtacagcctggcaggtccctgagactctcctgtgcagcctctggattcacctttgacgattatgccctacactgggtccggcaagctccagggaaggacctggagtgggtctcaggtattagttggaatggtggtagccagggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 241 - DNA, 381 bp, Homo sapiens
  source: /note="VH 1.41a"
gaggtgcagctggtggagtctgggggaggcttggtacagcctggcaggtccctgagactctcctgtgcagcctctggattcacctttgacgattatgccttccactgggtccggcaagctccagggaaggacctggagtgggtctcaggtattagttggaatggtggtagctacggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 242 - DNA, 381 bp, Homo sapiens
  source: /note="VH 1.42a"
gaggtgcagctggtggagtctgggggaggcttggtacagcctggcaggtccctgagactctcctgtgcagcctctggattcacctttgacgattatgccttccactgggtccggcaagctccagggaaggacctggagtgggtctcaggtattagttggaatggtggtagccagggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 243 - DNA, 381 bp, Homo sapiens
  source: /note="VH 1.43a"
gaggtgcagctggtggagtctgggggaggcttggtacagcctggcaggtccctgagactctcctgtgcagcctctggattcacctttgacgattatgccttccactgggtccggcaagctccagggaaggacctggagtgggtctcaggtattagttggaatgctggtagctacggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 244 - DNA, 381 bp, Homo sapiens
  source: /note="VH 1.44a"
gaggtgcagctggtggagtctgggggaggcttggtacagcctggcaggtccctgagactctcctgtgcagcctctggattcacctttgacgattatgccctacactgggtccggcaagctccagggaaggacctggagtgggtctcaggtattagttggaatagtggtagctacggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 245 - DNA, 381 bp, Homo sapiens
  source: /note="VH 1.45a"
gaggtgcagctggtggagtctgggggaggcttggtacagcctggcaggtccctgagactctcctgtgcagcctctggattcacctttgacgattatgccctacactgggtccggcaagctccagggaaggacctggagtgggtctcaggtattagttggaatgctggtagccagggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 246 - DNA, 381 bp, Homo sapiens
  source: /note="VH 1.46a"
gaggtgcagctggtggagtctgggggaggcttggtacagcctggcaggtccctgagactctcctgtgcagcctctggattcacctttgacgattatgccctacactgggtccggcaagctccagggaaggacctggagtgggtctcaggtattagttggaatgctggtagctacggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 247 - DNA, 381 bp, Homo sapiens
  source: /note="VH 1.47a"
gaggtgcagctggtggagtctgggggaggcttggtacagcctggcaggtccctgagactctcctgtgcagcctctggattcacctttgacgattatgccttccactgggtccggcaagctccagggaaggacctggagtgggtctcaggtattagttggaatagtggtagctacggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 248 - DNA, 381 bp, Homo sapiens
  source: /note="VH 1.48a"
gaggtgcagctggtggagtctgggggaggcttggtacagcctggcaggtccctgagactctcctgtgcagcctctggattcacctttgacgattatgccctacactgggtccggcaagctccagggaaggacctggagtgggtctcaggtattagttggaatagtggtagccagggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 249 - DNA, 381 bp, Homo sapiens
  source: /note="VH 1.49a"
gaggtgcagctggtggagtctgggggaggcttggtacagcctggcaggtccctgagactctcctgtgcagcctctggattcacctttgacgattatgccttccactgggtccggcaagctccagggaaggacctggagtgggtctcaggtattagttggaatagtggtagccagggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 250 - DNA, 381 bp, Homo sapiens
  source: /note="VH 1.50a"
gaggtgcagctggtggagtctgggggaggcttggtacagcctggcaggtccctgagactctcctgtgcagcctctggattcacctttgacgattatgccttccactgggtccggcaagctccagggaaggacctggagtgggtctcaggtattagttggaatgctggtagccagggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 251 - protein, 5 aa, Homo sapiens
  source: /note="CDR1 sequence of SEQ ID NO: 254"
DYAMS

SEQ ID NO: 252 - protein, 17 aa, Homo sapiens
  source: /note="CDR2 sequence of SEQ ID NO: 254"
GITWNGGSTGYADSVKD

SEQ ID NO: 253 - protein, 14 aa, Homo sapiens
  source: /note="CDR3 sequence of SEQ ID NO: 254"
DKYSYAWSYDGFDI

SEQ ID NO: 254 - protein, 123 aa, Homo sapiens
  source: /note="VH 1.51a"
EVQLVESGGGVVRPGGSLRLSCAASGFTFDDYAMSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 255 - protein, 5 aa, Homo sapiens
  source: /note="CDR1 sequence of SEQ ID NO: 258"
DYGMS

SEQ ID NO: 256 - protein, 17 aa, Homo sapiens
  source: /note="CDR2 sequence of SEQ ID NO: 258"
GISRNGGSAGYSDSAKD

SEQ ID NO: 257 - protein, 14 aa, Homo sapiens
  source: /note="CDR3 sequence of SEQ ID NO: 258"
EKYSSGWSYDDFDI

SEQ ID NO: 258 - protein, 123 aa, Homo sapiens
  source: /note="VH 1.52a"
EVQLLESGGGVVRPGGSLRLSCAASGFTFDDYGMSWVRQPPGKGLEWVSGISRNGGSAGYSDSAKDRFTISRDNAKNSLYLQMNSLRADDTAMYYCAREKYSSGWSYDDFDIWGQGTMVTVSS

SEQ ID NO: 259 - protein, 5 aa, Homo sapiens
  source: /note="CDR1 sequence of SEQ ID NO: 262"
DYGMS

SEQ ID NO: 260 - protein, 17 aa, Homo sapiens
  source: /note="CDR2 sequence of SEQ ID NO: 262"
GISRNGGSAGYSDSAKD

SEQ ID NO: 261 - protein, 14 aa, Homo sapiens
  source: /note="CDR3 sequence of SEQ ID NO: 262"
EKYSSGWSYDDFDI

SEQ ID NO: 262 - protein, 123 aa, Homo sapiens
  source: /note="VH 1.53a"
QVQLVESGGGVVRPGGSLRLSCAASGFTFDDYGMSWVRQSPGKGLEWVSGISRNGGSAGYSDSAKDRFTISRDNAKNSLYLQMNSLRADDTAMYYCAREKYSSGWSYDDFDIWGQGTMVTVSS

SEQ ID NO: 263 - protein, 5 aa, Homo sapiens
  source: /note="CDR1 sequence of SEQ ID NO: 266"
DYGMS

SEQ ID NO: 264 - protein, 17 aa, Homo sapiens
  source: /note="CDR2 sequence of SEQ ID NO: 266"
GISRNGGSAGYSDSAKD

SEQ ID NO: 265 - protein, 14 aa, Homo sapiens
  source: /note="CDR3 sequence of SEQ ID NO: 266"
EKYSSGWSYDDFDI

SEQ ID NO: 266 - protein, 123 aa, Homo sapiens
  source: /note="VH 1.54a"
QVQLVESGGGVVRPGGSLRLSCAASGFTFDDYGMSWVRQPPGKGLEWVSGISRNGGSAGYSDSAKDRFTISRDNAKNSLYLQMNSLRADDTAMYYCAREKYSSGWSYDDFDIWGQGTMVTVSS

SEQ ID NO: 267 - protein, 5 aa, Homo sapiens
  source: /note="CDR1 sequence of SEQ ID NO: 270"
DYGMS

SEQ ID NO: 268 - protein, 17 aa, Homo sapiens
  source: /note="CDR2 sequence of SEQ ID NO: 270"
GISRNGGSAGYSDSAKD

SEQ ID NO: 269 - protein, 14 aa, Homo sapiens
  source: /note="CDR3 sequence of SEQ ID NO: 270"
EKYSSGWSYDDFDI

SEQ ID NO: 270 - protein, 123 aa, Homo sapiens
  source: /note="VH 1.55a"
EVQLVESGGGVVRPGGSLRLSCAASGFTFDDYGMSWVRQPPGKGLEWVSGISRNGGSAGYSDSAKDRFTISRDNAKNSLYLQMNSLRADDTAMYYCAREKYSSGWSYDDFDIWGQGTMVTVSS

SEQ ID NO: 271 - protein, 5 aa, Homo sapiens
  source: /note="CDR1 sequence of SEQ ID NO: 274"
DYGMS

SEQ ID NO: 272 - protein, 17 aa, Homo sapiens
  source: /note="CDR2 sequence of SEQ ID NO: 274"
GISRNGGSTGYADSVKD

SEQ ID NO: 273 - protein, 14 aa, Homo sapiens
  source: /note="CDR3 sequence of SEQ ID NO: 274"
DPYSSGWSYDSFDI

SEQ ID NO: 274 - protein, 123 aa, Homo sapiens
  source: /note="VH 1.56a"
QVQLVESGGGVVRLGGSLRLSCAASGFSFVDYGMSWVRQAPGQGLEWVSGISRNGGSTGYADSVKDRFTISRDNAKNTLYLQMNSLRAEDTALYYCARDPYSSGWSYDSFDIWGQGTMVTVSS

SEQ ID NO: 275 - protein, 5 aa, Homo sapiens
  source: /note="CDR1 sequence of SEQ ID NO: 278"
DYGMS

SEQ ID NO: 276 - protein, 17 aa, Homo sapiens
  source: /note="CDR2 sequence of SEQ ID NO: 278"
GISRNGGSTGYTASVKD

SEQ ID NO: 277 - protein, 14 aa, Homo sapiens
  source: /note="CDR3 sequence of SEQ ID NO: 278"
EKYSSGWSYDDFDI

SEQ ID NO: 278 - protein, 123 aa, Homo sapiens
  source: /note="VH 1.57a"
QVQLVESGGGVVRPGGSLRLSCAASGFTFDDYGMSWVRQAPGKGLEWVSGISRNGGSTGYTASVKDRFTISRDNAKNSLYLQMNSLRADDTAMYYCAREKYSSGWSYDDFDIWGQGTMVTVSS

SEQ ID NO: 279 - protein, 5 aa, Homo sapiens
  source: /note="CDR1 sequence of SEQ ID NO: 282"
DYAMS

SEQ ID NO: 280 - protein, 17 aa, Homo sapiens
  source: /note="CDR2 sequence of SEQ ID NO: 282"
GISWNGGSAGYADSVKD

SEQ ID NO: 281 - protein, 14 aa, Homo sapiens
  source: /note="CDR3 sequence of SEQ ID NO: 282"
DPHSSAWSYDAFDI

SEQ ID NO: 282 - protein, 123 aa, Homo sapiens
  source: /note="VH 1.58a"
QVQLVESGGGLVQPGGSLRLSCAASGFTFDDYAMSWVRQAPGKGLEWVSGISWNGGSAGYADSVKDRFTISRDNAKNSLYLQMNSLRAEDTALYYCARDPHSSAWSYDAFDIWGQGTMVTVSS

SEQ ID NO: 283 - protein, 5 aa, Homo sapiens
  source: /note="CDR1 sequence of SEQ ID NO: 286"
DYAMS

SEQ ID NO: 284 - protein, 17 aa, Homo sapiens
  source: /note="CDR2 sequence of SEQ ID NO: 286"
GISWNGGSKGYADSVKD

SEQ ID NO: 285 - protein, 14 aa, Homo sapiens
  source: /note="CDR3 sequence of SEQ ID NO: 286"
DPYSGAWSYDAFDI

SEQ ID NO: 286 - protein, 123 aa, Homo sapiens
  source: /note="VH 1.59a"
QVQLVESGGGVVRPGGSLRLSCAASGFTFDDYAMSWVRQAPGKGLEWVSGISWNGGSKGYADSVKDRFTISRDNAKNSLYLQMNSLRAEDTALYYCARDPYSGAWSYDAFDIWGQGTMVTVSS

SEQ ID NO: 287 - protein, 5 aa, Homo sapiens
  source: /note="CDR1 sequence of SEQ ID NO: 290"
DYAMS

SEQ ID NO: 288 - protein, 17 aa, Homo sapiens
  source: /note="CDR2 sequence of SEQ ID NO: 290"
GISWNGGSTGYADSVKD

SEQ ID NO: 289 - protein, 14 aa, Homo sapiens
  source: /note="CDR3 sequence of SEQ ID NO: 290"
DPYSGAWSYDAFDI

SEQ ID NO: 290 - protein, 123 aa, Homo sapiens
  source: /note="VH 1.60a"
QVQLVESGGGVVRPGGSLRLSCAASGFTFDDYAMSWVRQAPGKGLEWVSGISWNGGSTGYADSVKDRFTISRDNAKNSLYLQMNSLRAEDTALYYCARDPYSGAWSYDAFDIWGQGTMVTVSS

SEQ ID NO: 291 - protein, 5 aa, Homo sapiens
  source: /note="CDR1 sequence of SEQ ID NO: 294"
NYAMS

SEQ ID NO: 292 - protein, 17 aa, Homo sapiens
  source: /note="CDR2 sequence of SEQ ID NO: 294"
GITWNGGSTGYADSVKD

SEQ ID NO: 293 - protein, 14 aa, Homo sapiens
  source: /note="CDR3 sequence of SEQ ID NO: 294"
DKYSYAWSYDTFDI

SEQ ID NO: 294 - protein, 123 aa, Homo sapiens
  source: /note="VH 1.61a"
QVQLVESGGGVVRPGGSLRLSCAASGFTFDNYAMSWVRQAPGKGLEWVSGITWNGGSTGYADSVKDRFTISRDNAKNSLYLQMNSLRAEDTALYYCARDKYSYAWSYDTFDIRGQGTMVTVSS

SEQ ID NO: 295 - protein, 5 aa, Homo sapiens
  source: /note="CDR1 sequence of SEQ ID NO: 298"
DYAMS

SEQ ID NO: 296 - protein, 17 aa, Homo sapiens
  source: /note="CDR2 sequence of SEQ ID NO: 298"
GITWNAGSTGYADSVKG

SEQ ID NO: 297 - protein, 14 aa, Homo sapiens
  source: /note="CDR3 sequence of SEQ ID NO: 298"
DKYSYAWSYDDFDI

SEQ ID NO: 298 - protein, 123 aa, Homo sapiens
  source: /note="VH 1.62a"
EVQLVESGGGVVRPGGSLRLSCAASGFTFDDYAMSWVRQAPGKGLEWVSGITWNAGSTGYADSVKGRFTISRDNAKNSLYLQMNSLRAEDTALYYCVRDKYSYAWSYDDFDIWGQGTMVTVSS

SEQ ID NO: 299 - protein, 5 aa, Homo sapiens
  source: /note="CDR1 sequence of SEQ ID NO: 302"
DYAMS

SEQ ID NO: 300 - protein, 17 aa, Homo sapiens
  source: /note="CDR2 sequence of SEQ ID NO: 302"
GITWNRGSTGYADSVKG

SEQ ID NO: 301 - protein, 14 aa, Homo sapiens
  source: /note="CDR3 sequence of SEQ ID NO: 302"
DKYSYAWSYDDFDI

SEQ ID NO: 302 - protein, 123 aa, Homo sapiens
  source: /note="VH 1.63a"
EVQLVESGGGVVRPGGSLRLSCAASGFTFDDYAMSWVRQAPGKGLEWVSGITWNRGSTGYADSVKGRFTISRDNAKNSLYLQMNSLRAEDTALYYCVRDKYSYAWSYDDFDIWGQGTMVTVSS

SEQ ID NO: 303 - protein, 5 aa, Homo sapiens
  source: /note="CDR1 sequence of SEQ ID NO: 306"
DYAFS

SEQ ID NO: 304 - protein, 17 aa, Homo sapiens
  source: /note="CDR2 sequence of SEQ ID NO: 306"
GITWNGGSTGYADSVKG

SEQ ID NO: 305 - protein, 14 aa, Homo sapiens
  source: /note="CDR3 sequence of SEQ ID NO: 306"
DKYSYAWSYDGFDI

SEQ ID NO: 306 - protein, 123 aa, Homo sapiens
  source: /note="VH 1.64a"
EVQLVESGGGVVRPGGSLRLSCAASGFTFDDYAFSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 307 - protein, 5 aa, Homo sapiens
  source: /note="CDR1 sequence of SEQ ID NO: 310"
DYAQS

SEQ ID NO: 308 - protein, 17 aa, Homo sapiens
  source: /note="CDR2 sequence of SEQ ID NO: 310"
GITWNGGSTGYADSVKG

SEQ ID NO: 309 - protein, 14 aa, Homo sapiens
  source: /note="CDR3 sequence of SEQ ID NO: 310"
DKYSYAWSYDGFDI

SEQ ID NO: 310 - protein, 123 aa, Homo sapiens
  source: /note="VH 1.65a"
EVQLVESGGGVVRPGGSLRLSCAASGFTFDDYAQSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 311 - protein, 5 aa, Homo sapiens
  source: /note="CDR1 sequence of SEQ ID NO: 314"
DYANS

SEQ ID NO: 312 - protein, 17 aa, Homo sapiens
  source: /note="CDR2 sequence of SEQ ID NO: 314"
GITWNGGSTGYADSVKG

SEQ ID NO: 313 - protein, 14 aa, Homo sapiens
  source: /note="CDR3 sequence of SEQ ID NO: 314"
DKYSYAWSYDGFDI

SEQ ID NO: 314 - protein, 123 aa, Homo sapiens
  source: /note="VH 1.66a"
EVQLVESGGGVVRPGGSLRLSCAASGFTFDDYANSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 315 - protein, 5 aa, Homo sapiens
  source: /note="CDR1 sequence of SEQ ID NO: 318"
DYAGS

SEQ ID NO: 316 - protein, 17 aa, Homo sapiens
  source: /note="CDR2 sequence of SEQ ID NO: 318"
GITWNGGSTGYADSVKG

SEQ ID NO: 317 - protein, 14 aa, Homo sapiens
  source: /note="CDR3 sequence of SEQ ID NO: 318"
DKYSYAWSYDGFDI

SEQ ID NO: 318 - protein, 123 aa, Homo sapiens
  source: /note="VH 1.67a"
EVQLVESGGGVVRPGGSLRLSCAASGFTFDDYAGSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 319 - protein, 5 aa, Homo sapiens
  source: /note="CDR1 sequence of SEQ ID NO: 322"
DYAES

SEQ ID NO: 320 - protein, 17 aa, Homo sapiens
  source: /note="CDR2 sequence of SEQ ID NO: 322"
GITWNGGSTGYADSVKG

SEQ ID NO: 321 - protein, 14 aa, Homo sapiens
  source: /note="CDR3 sequence of SEQ ID NO: 322"
DKYSYAWSYDGFDI

SEQ ID NO: 322 - protein, 123 aa, Homo sapiens
  source: /note="VH 1.68a"
EVQLVESGGGVVRPGGSLRLSCAASGFTFDDYAESWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 323 - protein, 5 aa, Homo sapiens
  source: /note="CDR1 sequence of SEQ ID NO: 326"
DYAWS

SEQ ID NO: 324 - protein, 17 aa, Homo sapiens
  source: /note="CDR2 sequence of SEQ ID NO: 326"
GITWNGGSTGYADSVKG

SEQ ID NO: 325 - protein, 14 aa, Homo sapiens
  source: /note="CDR3 sequence of SEQ ID NO: 326"
DKYSYAWSYDGFDI

SEQ ID NO: 326 - protein, 123 aa, Homo sapiens
  source: /note="VH 1.69a"
EVQLVESGGGVVRPGGSLRLSCAASGFTFDDYAWSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 327 - protein, 5 aa, Homo sapiens
  source: /note="CDR1 sequence of SEQ ID NO: 330"
DYAVS

SEQ ID NO: 328 - protein, 17 aa, Homo sapiens
  source: /note="CDR2 sequence of SEQ ID NO: 330"
GITWNGGSTGYADSVKG

SEQ ID NO: 329 - protein, 14 aa, Homo sapiens
  source: /note="CDR3 sequence of SEQ ID NO: 330"
DKYSYAWSYDGFDI

SEQ ID NO: 330 - protein, 123 aa, Homo sapiens
  source: /note="VH 1.70a"
EVQLVESGGGVVRPGGSLRLSCAASGFTFDDYAVSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 331 - protein, 5 aa, Homo sapiens
  source: /note="CDR1 sequence of SEQ ID NO: 334"
DYALS

SEQ ID NO: 332 - protein, 17 aa, Homo sapiens
  source: /note="CDR2 sequence of SEQ ID NO: 334"
GITWNGGSTGYADSVKG

SEQ ID NO: 333 - protein, 14 aa, Homo sapiens
  source: /note="CDR3 sequence of SEQ ID NO: 334"
DKYSYAWSYDGFDI

SEQ ID NO: 334 - protein, 123 aa, Homo sapiens
  source: /note="VH 1.71a"
EVQLVESGGGVVRPGGSLRLSCAASGFTFDDYALSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 335 - protein, 5 aa, Homo sapiens
  source: /note="CDR1 sequence of SEQ ID NO: 338"
DYASS

SEQ ID NO: 336 - protein, 17 aa, Homo sapiens
  source: /note="CDR2 sequence of SEQ ID NO: 338"
GITWNGGSTGYADSVKG

SEQ ID NO: 337 - protein, 14 aa, Homo sapiens
  source: /note="CDR3 sequence of SEQ ID NO: 338"
DKYSYAWSYDGFDI

SEQ ID NO: 338 - protein, 123 aa, Homo sapiens
  source: /note="VH 1.72a"
EVQLVESGGGVVRPGGSLRLSCAASGFTFDDYASSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 339 - protein, 5 aa, Homo sapiens
  source: /note="CDR1 sequence of SEQ ID NO: 342"
DYARS

SEQ ID NO: 340 - protein, 17 aa, Homo sapiens
  source: /note="CDR2 sequence of SEQ ID NO: 342"
GITWNGGSTGYADSVKG

SEQ ID NO: 341 - protein, 14 aa, Homo sapiens
  source: /note="CDR3 sequence of SEQ ID NO: 342"
DKYSYAWSYDGFDI

SEQ ID NO: 342 - protein, 123 aa, Homo sapiens
  source: /note="VH 1.73a"
EVQLVESGGGVVRPGGSLRLSCAASGFTFDDYARSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 343 - protein, 5 aa, Homo sapiens
  source: /note="CDR1 sequence of SEQ ID NO: 346"
DYAMS

SEQ ID NO: 344 - protein, 17 aa, Homo sapiens
  source: /note="CDR2 sequence of SEQ ID NO: 346"
GITWNSGSTGYADSVKD

SEQ ID NO: 345 - protein, 14 aa, Homo sapiens
  source: /note="CDR3 sequence of SEQ ID NO: 346"
DKYSYAWSYDDFDI

SEQ ID NO: 346 - protein, 123 aa, Homo sapiens
  source: /note="VH 1.74a"
EVQLVESGGGVVRPGGSLRLSCAASGFTFDDYAMSWVRQAPGKGLEWVSGITWNSGSTGYADSVKDRFTISRDNAKNSLYLQMNSLRAEDTALYYCVRDKYSYAWSYDDFDIWGQGTMVTVSS

SEQ ID NO: 347 - protein, 5 aa, Homo sapiens
  source: /note="CDR1 sequence of SEQ ID NO: 350"
DYAMS

SEQ ID NO: 348 - protein, 17 aa, Homo sapiens
  source: /note="CDR2 sequence of SEQ ID NO: 350"
GITWNQGSTGYADSVKD

SEQ ID NO: 349 - protein, 14 aa, Homo sapiens
  source: /note="CDR3 sequence of SEQ ID NO: 350"
DKYSYAWSYDDFDI

SEQ ID NO: 350 - protein, 123 aa, Homo sapiens
  source: /note="VH 1.75a"
EVQLVESGGGVVRPGGSLRLSCAASGFTFDDYAMSWVRQAPGKGLEWVSGITWNQGSTGYADSVKDRFTISRDNAKNSLYLQMNSLRAEDTALYYCVRDKYSYAWSYDDFDIWGQGTMVTVSS

SEQ ID NO: 351 - protein, 5 aa, Homo sapiens
  source: /note="CDR1 sequence of SEQ ID NO: 354"
DYAMS

SEQ ID NO: 352 - protein, 17 aa, Homo sapiens
  source: /note="CDR2 sequence of SEQ ID NO: 354"
GITWNHGSTGYADSVKD

SEQ ID NO: 353 - protein, 14 aa, Homo sapiens
  source: /note="CDR3 sequence of SEQ ID NO: 354"
DKYSYAWSYDVFDI

SEQ ID NO: 354 - protein, 123 aa, Homo sapiens
  source: /note="VH 1.76a"
EVQLVESGGGVVRPGGSLRLSCAASGFTFDDYAMSWVRQAPGKGLEWVSGITWNHGSTGYADSVKDRFTISRDNAKNSLYLQMNSLRAEDTALYYCVRDKYSYAWSYDVFDIWGQGTMVTVSS

SEQ ID NO: 355 - protein, 5 aa, Homo sapiens
  source: /note="CDR1 sequence of SEQ ID NO: 358"
DYAMS

SEQ ID NO: 356 - protein, 17 aa, Homo sapiens
  source: /note="CDR2 sequence of SEQ ID NO: 358"
GITWNAGSTGYADSVKD

SEQ ID NO: 357 - protein, 14 aa, Homo sapiens
  source: /note="CDR3 sequence of SEQ ID NO: 358"
DKYSYAWSYDDFDI

SEQ ID NO: 358 - protein, 123 aa, Homo sapiens
  source: /note="VH 1.77a"
EVQLVESGGGVVRPGGSLRLSCAASGFTFDDYAMSWVRQAPGKGLEWVSGITWNAGSTGYADSVKDRFTISRDNAKNSLYLQMNSLRAEDTALYYCVRDKYSYAWSYDDFDIWGQGTMVTVSS

SEQ ID NO: 359 - protein, 5 aa, Homo sapiens
  source: /note="CDR1 sequence of SEQ ID NO: 362"
DYAMS

SEQ ID NO: 360 - protein, 17 aa, Homo sapiens
  source: /note="CDR2 sequence of SEQ ID NO: 362"
GITWNGGSTGYADSVKG

SEQ ID NO: 361 - protein, 14 aa, Homo sapiens
  source: /note="CDR3 sequence of SEQ ID NO: 362"
DKYSYAWSYDVFDI

SEQ ID NO: 362 - protein, 123 aa, Homo sapiens
  source: /note="VH 1.78a"
EVQLVESGGGVVRPGGSLRLSCAASGFTFDDYAMSWVRQAPGKGLEWVSGITWNGGSTGYADSVKGRFTISRDNAKNSLYLQMNSLRAEDTALYYCVRDKYSYAWSYDVFDIWGQGTMVTVSS

SEQ ID NO: 363 - protein, 5 aa, Homo sapiens
  source: /note="CDR1 sequence of SEQ ID NO: 366"
DYAMS

SEQ ID NO: 364 - protein, 17 aa, Homo sapiens
  source: /note="CDR2 sequence of SEQ ID NO: 366"
GITWNGGSTGYADSVKG

SEQ ID NO: 365 - protein, 14 aa, Homo sapiens
  source: /note="CDR3 sequence of SEQ ID NO: 366"
DKYSYAWSYDDFDI

SEQ ID NO: 366 - protein, 123 aa, Homo sapiens
  source: /note="VH 1.79a"
EVQLVESGGGVVRPGGSLRLSCAASGFTFDDYAMSWVRQAPGKGLEWVSGITWNGGSTGYADSVKGRFTISRDNAKNSLYLQMNSLRAEDTALYYCVRDKYSYAWSYDDFDIWGQGTMVTVSS

SEQ ID NO: 367 - protein, 5 aa, Homo sapiens
  source: /note="CDR1 sequence of SEQ ID NO: 370"
DYAMS

SEQ ID NO: 368 - protein, 17 aa, Homo sapiens
  source: /note="CDR2 sequence of SEQ ID NO: 370"
GITWNKGSTGYADSVKD

SEQ ID NO: 369 - protein, 14 aa, Homo sapiens
  source: /note="CDR3 sequence of SEQ ID NO: 370"
DKYSYAWSYDDFDI

SEQ ID NO: 370 - protein, 123 aa, Homo sapiens
  source: /note="VH 1.80a"
EVQLVESGGGVVRPGGSLRLSCAASGFTFDDYAMSWVRQAPGKGLEWVSGITWNKGSTGYADSVKDRFTISRDNAKNSLYLQMNSLRAEDTALYYCVRDKYSYAWSYDDFDIWGQGTMVTVSS

SEQ ID NO: 371 - protein, 5 aa, Homo sapiens
  source: /note="CDR1 sequence of SEQ ID NO: 374"
DYAMS

SEQ ID NO: 372 - protein, 17 aa, Homo sapiens
  source: /note="CDR2 sequence of SEQ ID NO: 374"
GITWNRGSTGYADSVKD

SEQ ID NO: 373 - protein, 14 aa, Homo sapiens
  source: /note="CDR3 sequence of SEQ ID NO: 374"
DKYSYAWSYDDFDI

SEQ ID NO: 374 - protein, 123 aa, Homo sapiens
  source: /note="VH 1.81a"
EVQLVESGGGVVRPGGSLRLSCAASGFTFDDYAMSWVRQAPGKGLEWVSGITWNRGSTGYADSVKDRFTISRDNAKNSLYLQMNSLRAEDTALYYCVRDKYSYAWSYDDFDIWGQGTMVTVSS

SEQ ID NO: 375 - protein, 5 aa, Homo sapiens
  source: /note="CDR1 sequence of SEQ ID NO: 378"
DYAIS

SEQ ID NO: 376 - protein, 17 aa, Homo sapiens
  source: /note="CDR2 sequence of SEQ ID NO: 378"
GITWNGGSTGYADSVKD

SEQ ID NO: 377 - protein, 14 aa, Homo sapiens
  source: /note="CDR3 sequence of SEQ ID NO: 378"
DKYSYAWSYDGFDI

SEQ ID NO: 378 - protein, 123 aa, Homo sapiens
  source: /note="VH 1.82a"
EVQLVESGGGVVRPGGSLRLSCAASGFTFDDYAISWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 379 - protein, 5 aa, Homo sapiens
  source: /note="CDR1 sequence of SEQ ID NO: 382"
DYATS

SEQ ID NO: 380 - protein, 17 aa, Homo sapiens
  source: /note="CDR2 sequence of SEQ ID NO: 382"
GITWNGGSTGYADSVKD

SEQ ID NO: 381 - protein, 14 aa, Homo sapiens
  source: /note="CDR3 sequence of SEQ ID NO: 382"
DKYSYAWSYDGFDI

SEQ ID NO: 382 - protein, 123 aa, Homo sapiens
  source: /note="VH 1.83a"
EVQLVESGGGVVRPGGSLRLSCAASGFTFDDYATSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 383 - protein, 5 aa, Homo sapiens
  source: /note="CDR1 sequence of SEQ ID NO: 386"
DYANS

SEQ ID NO: 384 - protein, 17 aa, Homo sapiens
  source: /note="CDR2 sequence of SEQ ID NO: 386"
GITWNGGSTGYADSVKD

SEQ ID NO: 385 - protein, 14 aa, Homo sapiens
  source: /note="CDR3 sequence of SEQ ID NO: 386"
DKYSYAWSYDGFDI

SEQ ID NO: 386 - protein, 123 aa, Homo sapiens
  source: /note="VH 1.84a"
EVQLVESGGGVVRPGGSLRLSCAASGFTFDDYANSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 387 - protein, 5 aa, Homo sapiens
  source: /note="CDR1 sequence of SEQ ID NO: 390"
DYADS

SEQ ID NO: 388 - protein, 17 aa, Homo sapiens
  source: /note="CDR2 sequence of SEQ ID NO: 390"
GITWNGGSTGYADSVKD

SEQ ID NO: 389 - protein, 14 aa, Homo sapiens
  source: /note="CDR3 sequence of SEQ ID NO: 390"
DKYSYAWSYDGFDI

SEQ ID NO: 390 - protein, 123 aa, Homo sapiens
  source: /note="VH 1.85a"
EVQLVESGGGVVRPGGSLRLSCAASGFTFDDYADSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 391 - protein, 5 aa, Homo sapiens
  source: /note="CDR1 sequence of SEQ ID NO: 394"
DYASS

SEQ ID NO: 392 - protein, 17 aa, Homo sapiens
  source: /note="CDR2 sequence of SEQ ID NO: 394"
GITWNGGSTGYADSVKD

SEQ ID NO: 393 - protein, 14 aa, Homo sapiens
  source: /note="CDR3 sequence of SEQ ID NO: 394"
DKYSYAWSYDGFDI

SEQ ID NO: 394 - protein, 123 aa, Homo sapiens
  source: /note="VH 1.86a"
EVQLVESGGGVVRPGGSLRLSCAASGFTFDDYASSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 395 - protein, 5 aa, Homo sapiens
  source: /note="CDR1 sequence of SEQ ID NO: 398"
DYALS

SEQ ID NO: 396 - protein, 17 aa, Homo sapiens
  source: /note="CDR2 sequence of SEQ ID NO: 398"
GITWNGGSTGYADSVKD

SEQ ID NO: 397 - protein, 14 aa, Homo sapiens
  source: /note="CDR3 sequence of SEQ ID NO: 398"
DKYSYAWSYDGFDI

SEQ ID NO: 398 - protein, 123 aa, Homo sapiens
  source: /note="VH 1.87a"
EVQLVESGGGVVRPGGSLRLSCAASGFTFDDYALSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 399 - protein, 5 aa, Homo sapiens
  source: /note="CDR1 sequence of SEQ ID NO: 402"
DYAGS

SEQ ID NO: 400 - protein, 17 aa, Homo sapiens
  source: /note="CDR2 sequence of SEQ ID NO: 402"
GITWNGGSTGYADSVKD

SEQ ID NO: 401 - protein, 14 aa, Homo sapiens
  source: /note="CDR3 sequence of SEQ ID NO: 402"
DKYSYAWSYDGFDI

SEQ ID NO: 402 - protein, 123 aa, Homo sapiens
  source: /note="VH 1.88a"
EVQLVESGGGVVRPGGSLRLSCAASGFTFDDYAGSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 403 - protein, 5 aa, Homo sapiens
  source: /note="CDR1 sequence of SEQ ID NO: 406"
DYAES

SEQ ID NO: 404 - protein, 17 aa, Homo sapiens
  source: /note="CDR2 sequence of SEQ ID NO: 406"
GITWNGGSTGYADSVKD

SEQ ID NO: 405 - protein, 14 aa, Homo sapiens
  source: /note="CDR3 sequence of SEQ ID NO: 406"
DKYSYAWSYDGFDI

SEQ ID NO: 406 - protein, 123 aa, Homo sapiens
  source: /note="VH 1.89a"
EVQLVESGGGVVRPGGSLRLSCAASGFTFDDYAESWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 407 - protein, 5 aa, Homo sapiens
  source: /note="CDR1 sequence of SEQ ID NO: 410"
DYAWS

SEQ ID NO: 408 - protein, 17 aa, Homo sapiens
  source: /note="CDR2 sequence of SEQ ID NO: 410"
GITWNGGSTGYADSVKD

SEQ ID NO: 409 - protein, 14 aa, Homo sapiens
  source: /note="CDR3 sequence of SEQ ID NO: 410"
DKYSYAWSYDGFDI

SEQ ID NO: 410 - protein, 123 aa, Homo sapiens
  source: /note="VH 1.90a"
EVQLVESGGGVVRPGGSLRLSCAASGFTFDDYAWSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 411 - protein, 5 aa, Homo sapiens
  source: /note="CDR1 sequence of SEQ ID NO: 414"
DYARS

SEQ ID NO: 412 - protein, 17 aa, Homo sapiens
  source: /note="CDR2 sequence of SEQ ID NO: 414"
GITWNGGSTGYADSVKD

SEQ ID NO: 413 - protein, 14 aa, Homo sapiens
  source: /note="CDR3 sequence of SEQ ID NO: 414"
DKYSYAWSYDGFDI

SEQ ID NO: 414 - protein, 123 aa, Homo sapiens
  source: /note="VH 1.91a"
EVQLVESGGGVVRPGGSLRLSCAASGFTFDDYARSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 415 - protein, 5 aa, Homo sapiens
  source: /note="CDR1 sequence of SEQ ID NO: 418"
DYAFS

SEQ ID NO: 416 - protein, 17 aa, Homo sapiens
  source: /note="CDR2 sequence of SEQ ID NO: 418"
GITWNGGSTGYADSVKD

SEQ ID NO: 417 - protein, 14 aa, Homo sapiens
  source: /note="CDR3 sequence of SEQ ID NO: 418"
DKYSYAWSYDGFDI

SEQ ID NO: 418 - protein, 123 aa, Homo sapiens
  source: /note="VH 1.92a"
EVQLVESGGGVVRPGGSLRLSCAASGFTFDDYAFSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 419 - protein, 5 aa, Homo sapiens
  source: /note="CDR1 sequence of SEQ ID NO: 422"
DYAVS

SEQ ID NO: 420 - protein, 17 aa, Homo sapiens
  source: /note="CDR2 sequence of SEQ ID NO: 422"
GITWNGGSTGYADSVKD

SEQ ID NO: 421 - protein, 14 aa, Homo sapiens
  source: /note="CDR3 sequence of SEQ ID NO: 422"
DKYSYAWSYDGFDI

SEQ ID NO: 422 - protein, 123 aa, Homo sapiens
  source: /note="VH 1.93a"
EVQLVESGGGVVRPGGSLRLSCAASGFTFDDYAVSWVRQAPGKGLEWVSGITWNGGSTGYADSVKDRFTISRDNAKNSLYLQMNSLRAEDTALYYCVRDKYSYAWSYDGFDIWGQGTMVTVSS

SEQ ID NO: 423 - protein, 5 aa, Homo sapiens
  source: /note="CDR1 sequence of SEQ ID NO: 426"
DYAMS

SEQ ID NO: 424 - protein, 17 aa, Homo sapiens
  source: /note="CDR2 sequence of SEQ ID NO: 426"
GITWTGGSTGYADSVKD

SEQ ID NO: 425 - protein, 14 aa, Homo sapiens
  source: /note="CDR3 sequence of SEQ ID NO: 426"
DKYSYAWSYDGFDI

SEQ ID NO: 426 - protein, 123 aa, Homo sapiens
  source: /note="VH 1.94a"
EVQLVESGGGVVRPGGSLRLSCAASGFTFDDYAMSWVRQAPGKGLEWVSGITWTGGSTGYADSVKDRFTISRDNAKNSLYLQMNSLRAEDTALYYCVRDKYSYAWSYDGFDIWGQGTMVTVSS

SEQ ID NO: 427 - protein, 5 aa, Homo sapiens
  source: /note="CDR1 sequence of SEQ ID NO: 430"
DYAMS

SEQ ID NO: 428 - protein, 17 aa, Homo sapiens
  source: /note="CDR2 sequence of SEQ ID NO: 430"
GITWSGGSTGYADSVKD

SEQ ID NO: 429 - protein, 14 aa, Homo sapiens
  source: /note="CDR3 sequence of SEQ ID NO: 430"
DKYSYAWSYDGFDI

SEQ ID NO: 430 - protein, 123 aa, Homo sapiens
  source: /note="VH 1.95a"
EVQLVESGGGVVRPGGSLRLSCAASGFTFDDYAMSWVRQAPGKGLEWVSGITWSGGSTGYADSVKDRFTISRDNAKNSLYLQMNSLRAEDTALYYCVRDKYSYAWSYDGFDIWGQGTMVTVSS

SEQ ID NO: 431 - protein, 5 aa, Homo sapiens
  source: /note="CDR1 sequence of SEQ ID NO: 434"
DYAMS

SEQ ID NO: 432 - protein, 17 aa, Homo sapiens
  source: /note="CDR2 sequence of SEQ ID NO: 434"
GITWPGGSTGYADSVKD

SEQ ID NO: 433 - protein, 14 aa, Homo sapiens
  source: /note="CDR3 sequence of SEQ ID NO: 434"
DKYSYAWSYDGFDI

SEQ ID NO: 434 - protein, 123 aa, Homo sapiens
  source: /note="VH 1.96a"
EVQLVESGGGVVRPGGSLRLSCAASGFTFDDYAMSWVRQAPGKGLEWVSGITWPGGSTGYADSVKDRFTISRDNAKNSLYLQMNSLRAEDTALYYCVRDKYSYAWSYDGFDIWGQGTMVTVSS

SEQ ID NO: 435 - protein, 5 aa, Homo sapiens
  source: /note="CDR1 sequence of SEQ ID NO: 438"
DYAMS

SEQ ID NO: 436 - protein, 17 aa, Homo sapiens
  source: /note="CDR2 sequence of SEQ ID NO: 438"
GITWIGGSTGYADSVKD

SEQ ID NO: 437 - protein, 14 aa, Homo sapiens
  source: /note="CDR3 sequence of SEQ ID NO: 438"
DKYSYAWSYDGFDI

SEQ ID NO: 438 - protein, 123 aa, Homo sapiens
  source: /note="VH 1.97a"
EVQLVESGGGVVRPGGSLRLSCAASGFTFDDYAMSWVRQAPGKGLEWVSGITWIGGSTGYADSVKDRFTISRDNAKNSLYLQMNSLRAEDTALYYCVRDKYSYAWSYDGFDIWGQGTMVTVSS

SEQ ID NO: 439 - protein, 5 aa, Homo sapiens
  source: /note="CDR1 sequence of SEQ ID NO: 442"
DYAMS

SEQ ID NO: 440 - protein, 17 aa, Homo sapiens
  source: /note="CDR2 sequence of SEQ ID NO: 442"
GITWLGGSTGYADSVKD

SEQ ID NO: 441 - protein, 14 aa, Homo sapiens
  source: /note="CDR3 sequence of SEQ ID NO: 442"
DKYSYAWSYDGFDI

SEQ ID NO: 442 - protein, 123 aa, Homo sapiens
  source: /note="VH 1.98a"
EVQLVESGGGVVRPGGSLRLSCAASGFTFDDYAMSWVRQAPGKGLEWVSGITWLGGSTGYADSVKDRFTISRDNAKNSLYLQMNSLRAEDTALYYCVRDKYSYAWSYDGFDIWGQGTMVTVSS

SEQ ID NO: 443 - protein, 5 aa, Homo sapiens
  source: /note="CDR1 sequence of SEQ ID NO: 446"
DYAMS

SEQ ID NO: 444 - protein, 17 aa, Homo sapiens
  source: /note="CDR2 sequence of SEQ ID NO: 446"
GITWNGGSTGYADSVKG

SEQ ID NO: 445 - protein, 14 aa, Homo sapiens
  source: /note="CDR3 sequence of SEQ ID NO: 446"
DKYSYAWSYDGFDI

SEQ ID NO: 446 - protein, 123 aa, Homo sapiens
  source: /note="VH 1.99a"
EVQLVESGGGVVRPGGSLRLSCAASGFTFDDYAMSWVRQAPGKGLEWVSGITWNGGSTGYADSVKGRFTISRDNAKNSLYLQMNSLRAEDTALYYCVRDKYSYAWSYDGFDIWGQGTMVTVSS

SEQ ID NO: 447 - protein, 5 aa, Homo sapiens
  source: /note="CDR1 sequence of SEQ ID NO: 450"
DYAMS

SEQ ID NO: 448 - protein, 17 aa, Homo sapiens
  source: /note="CDR2 sequence of SEQ ID NO: 450"
GITWKGGSTGYADSVKD

SEQ ID NO: 449 - protein, 14 aa, Homo sapiens
  source: /note="CDR3 sequence of SEQ ID NO: 450"
DKYSYAWSYDGFDI

SEQ ID NO: 450 - protein, 123 aa, Homo sapiens
  source: /note="VH 1.100a"
EVQLVESGGGVVRPGGSLRLSCAASGFTFDDYAMSWVRQAPGKGLEWVSGITWKGGSTGYADSVKDRFTISRDNAKNSLYLQMNSLRAEDTALYYCVRDKYSYAWSYDGFDIWGQGTMVTVSS

SEQ ID NO: 451 - protein, 5 aa, Homo sapiens
  source: /note="CDR1 sequence of SEQ ID NO: 454"
DYAMS

SEQ ID NO: 452 - protein, 17 aa, Homo sapiens
  source: /note="CDR2 sequence of SEQ ID NO: 454"
GITWRGGSTGYADSVKD

SEQ ID NO: 453 - protein, 14 aa, Homo sapiens
  source: /note="CDR3 sequence of SEQ ID NO: 454"
DKYSYAWSYDGFDI

SEQ ID NO: 454 - protein, 123 aa, Homo sapiens
  source: /note="VH 1.101a"
EVQLVESGGGVVRPGGSLRLSCAASGFTFDDYAMSWVRQAPGKGLEWVSGITWRGGSTGYADSVKDRFTISRDNAKNSLYLQMNSLRAEDTALYYCVRDKYSYAWSYDGFDIWGQGTMVTVSS

SEQ ID NO: 455 - protein, 5 aa, Homo sapiens
  source: /note="CDR1 sequence of SEQ ID NO: 458"
DYAMS

SEQ ID NO: 456 - protein, 17 aa, Homo sapiens
  source: /note="CDR2 sequence of SEQ ID NO: 458"
GITWNGGSTGYADSVKD

SEQ ID NO: 457 - protein, 14 aa, Homo sapiens
  source: /note="CDR3 sequence of SEQ ID NO: 458"
DKYSYAWSYDVFDI

SEQ ID NO: 458 - protein, 123 aa, Homo sapiens
  source: /note="VH 1.102a"
EVQLVESGGGVVRPGGSLRLSCAASGFTFDDYAMSWVRQAPGKGLEWVSGITWNGGSTGYADSVKDRFTISRDNAKNSLYLQMNSLRAEDTALYYCVRDKYSYAWSYDVFDIWGQGTMVTVSS

SEQ ID NO: 459 - protein, 5 aa, Homo sapiens
  source: /note="CDR1 sequence of SEQ ID NO: 462"
DYAMS

SEQ ID NO: 460 - protein, 17 aa, Homo sapiens
  source: /note="CDR2 sequence of SEQ ID NO: 462"
GITWNGGSTGYADSVKD

SEQ ID NO: 461 - protein, 14 aa, Homo sapiens
  source: /note="CDR3 sequence of SEQ ID NO: 462"
DKYSYAWSYDDFDI

SEQ ID NO: 462 - protein, 123 aa, Homo sapiens
  source: /note="VH 1.103a"
EVQLVESGGGVVRPGGSLRLSCAASGFTFDDYAMSWVRQAPGKGLEWVSGITWNGGSTGYADSVKDRFTISRDNAKNSLYLQMNSLRAEDTALYYCVRDKYSYAWSYDDFDIWGQGTMVTVSS

SEQ ID NO: 463 - DNA, 369 bp, Homo sapiens
  source: /note="VH 1.51a"
gaagtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcactgtctcctca

SEQ ID NO: 464 - DNA, 369 bp, Homo sapiens
  source: /note="VH 1.52a"
gaggtgcagctgttggagtctgggggaggtgtggtgcggccgggggggtccctgagactctcctgtgcagcctctggattcacctttgatgattatggcatgagctgggtccgccaacctccagggaaggggctggagtgggtctctggtataagtaggaatggtggtagcgcaggttattcagactctgcgaaggaccgatttaccatctccagagacaacgccaagaactccctctatctgcaaatgaacagtctgagagccgacgacacggccatgtattattgtgcgagagagaagtatagcagtggctggtcctatgatgattttgatatctggggccaagggacaatggtcaccgtctcctca

SEQ ID NO: 465 - DNA, 369 bp, Homo sapiens
  source: /note="VH 1.53a"
caggtgcagctggtggagtctgggggaggtgtggtgcggccgggggggtccctgagactctcctgtgcagcctctggattcacctttgatgattatggcatgagctgggtccgccaatctccagggaaggggctggagtgggtctctggtattagtaggaatggtggtagcgcaggttattcagactctgcgaaggaccgatttaccatctccagagacaacgccaagaactccctctatctgcaaatgaacagtctgagagccgacgacacggccatgtattattgtgcgagagagaagtatagcagtggctggtcctatgatgattttgatatctggggccaagggacaatggtcaccgtctcctca

SEQ ID NO: 466 - DNA, 369 bp, Homo sapiens
  source: /note="VH 1.54a"
caggtgcagctggtggagtctgggggaggtgtggtgcggccgggggggtccctgagactctcctgtgcagcctctggattcacctttgatgattatggcatgagctgggtccgccaacctccagggaaggggctggagtgggtctctggtattagtaggaatggtggtagcgcaggttattcagactctgcgaaagaccgatttaccatctccagagacaacgccaagaactccctctatctgcaaatgaacagtctgagagccgacgacacggccatgtattattgtgcgagagagaagtatagcagtggctggtcctatgatgattttgatatctggggccaagggacaatggtcactgtctcttca

SEQ ID NO: 467 - DNA, 369 bp, Homo sapiens
  source: /note="VH 1.55a"
gaagtgcagctggtggagtctgggggaggtgtggtgcggccgggggggtccctgagactctcctgtgcagcctctggattcacctttgatgattatggcatgagctgggtccgccaacctccagggaaggggctggagtgggtctctggtattagtaggaatggtggtagcgcaggttattcagactctgcgaaggaccgatttaccatctccagagacaacgccaagaactccctctatctgcaaatgaacagtctgagagccgacgacacggccatgtattattgtgcgagagagaagtatagcagtggctggtcctatgatgattttgatatctggggccaagggacaatggtcactgtctcctca

SEQ ID NO: 468 - DNA, 369 bp, Homo sapiens
  source: /note="VH 1.56a"
caggtgcagctggtggagtctgggggaggtgtggtacggcttggggggtccctgagactctcctgtgcagcctctggattcagctttgttgattatggcatgagctgggtccgacaagctccagggcaggggctggagtgggtctctggtattagtaggaacggtggtagcacaggttatgcagactctgtgaaggaccgattcaccatctccagagacaacgccaagaacaccctgtatctgcaaatgaacagtctgagagccgaggacacggccttgtattactgtgcgagagacccttatagcagtggctggtcctatgattcttttgatatctggggccaggggacaatggtcactgtctcctca

SEQ ID NO: 469 - DNA, 369 bp, Homo sapiens
  source: /note="VH 1.57a"
caggtgcagctggtggagtctgggggaggtgtggttcggcctggggggtccctgagactctcctgtgcagcctctggattcacctttgatgattatggcatgagctgggtccgccaagctccagggaagggactggagtgggtctctggtattagtcggaatggtggtagtacagggtatacagcctctgtgaaggaccgattcaccatctccagagacaacgccaagaactccctgtatctgcaaatgaacagtctgagagccgacgacacagccatgtattactgtgcgcgagagaagtatagcagtggctggtcctatgatgactttgatatctggggccaagggacaatggtcaccgtctcctca

SEQ ID NO: 470 - DNA, 369 bp, Homo sapiens
  source: /note="VH 1.58a"
caggtgcagctggtggagtctgggggaggcctggtccagcctggggggtccctgagactctcctgtgcagcctctggattcacctttgatgattatgccatgagctgggtccgccaagctccagggaaggggctggagtgggtctctggtattagttggaatggtggtagcgcaggttatgcagactctgtgaaggaccgattcaccatctccagagacaacgccaagaactccctgtatctgcaaatgaacagtctgagagccgaggacacggccttgtattactgtgcgagagatccccatagcagtgcctggtcctatgatgcttttgatatctggggccaagggacaatggtcaccgtctcttca

SEQ ID NO: 471 - DNA, 369 bp, Homo sapiens
  source: /note="VH 1.59a"
caggtgcagctggtggagtctgggggaggtgtggtacggcctggggggtccctgagactctcctgtgcagcctccggattcacctttgatgattatgccatgagctgggtccgccaagctccagggaaggggctggagtgggtctctggtattagttggaatggtggtagtaaaggttatgcagactctgtgaaggaccgattcaccatctccagagacaacgccaagaactccctgtatctgcaaatgaacagtctgagagccgaggacacggccttatattactgtgcgagagatccgtatagcggtgcctggtcctatgatgcttttgatatctggggccaagggacaatggtcactgtctcctca

SEQ ID NO: 472 - DNA, 369 bp, Homo sapiens
  source: /note="VH 1.60a"
caggtgcagctggtggagtctgggggaggtgtggtacggcctggggggtccctgagactctcctgtgcagcctctggattcacctttgatgattatgccatgagctgggtccgccaagctccagggaaggggctggagtgggtctctggtattagttggaatggtggtagtacaggttatgcagactctgtgaaggaccgattcaccatctccagagacaacgccaagaactccctgtatctgcaaatgaacagtctgagagccgaggacacggccttatattactgtgcgagagatccgtatagcggtgcctggtcctatgatgcttttgatatctggggccaagggacaatggtcactgtctcttca

SEQ ID NO: 473 - DNA, 369 bp, Homo sapiens
  source: /note="VH 1.61a"
caggtgcagctggtggagtctgggggaggtgtggtacggcctggggggtccctgagactctcctgtgcagcctctggattcacctttgataattatgccatgagctgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgcgagagacaagtatagctatgcctggtcttatgatacttttgatatccggggccaagggacaatggtcaccgtctcttca

SEQ ID NO: 474 - DNA, 369 bp, Homo sapiens
  source: /note="VH 1.62a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatgccggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 475 - DNA, 369 bp, Homo sapiens
  source: /note="VH 1.63a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatcggggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 476 - DNA, 369 bp, Homo sapiens
  source: /note="VH 1.64a"
gaggtgcagctggtggagtctgggggaggtgtggtacggcctggggggtccctgagactctcctgtgcagcctctggattcacctttgatgattatgccttcagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 477 - DNA, 369 bp, Homo sapiens
  source: /note="VH 1.65a"
gaggtgcagctggtggagtctgggggaggtgtggtacggcctggggggtccctgagactctcctgtgcagcctctggattcacctttgatgattatgcccagagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 478 - DNA, 369 bp, Homo sapiens
  source: /note="VH 1.66a"
gaggtgcagctggtggagtctgggggaggtgtggtacggcctggggggtccctgagactctcctgtgcagcctctggattcacctttgatgattatgccaacagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 479 - DNA, 369 bp, Homo sapiens
  source: /note="VH 1.67a"
gaggtgcagctggtggagtctgggggaggtgtggtacggcctggggggtccctgagactctcctgtgcagcctctggattcacctttgatgattatgccgggagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 480 - DNA, 369 bp, Homo sapiens
  source: /note="VH 1.68a"
gaggtgcagctggtggagtctgggggaggtgtggtacggcctggggggtccctgagactctcctgtgcagcctctggattcacctttgatgattatgccgagagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 481 - DNA, 369 bp, Homo sapiens
  source: /note="VH 1.69a"
gaggtgcagctggtggagtctgggggaggtgtggtacggcctggggggtccctgagactctcctgtgcagcctctggattcacctttgatgattatgcctggagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 482 - DNA, 369 bp, Homo sapiens
  source: /note="VH 1.70a"
gaggtgcagctggtggagtctgggggaggtgtggtacggcctggggggtccctgagactctcctgtgcagcctctggattcacctttgatgattatgccgtcagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 483 - DNA, 369 bp, Homo sapiens
  source: /note="VH 1.71a"
gaggtgcagctggtggagtctgggggaggtgtggtacggcctggggggtccctgagactctcctgtgcagcctctggattcacctttgatgattatgccttgagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 484 - DNA, 369 bp, Homo sapiens
  source: /note="VH 1.72a"
gaggtgcagctggtggagtctgggggaggtgtggtacggcctggggggtccctgagactctcctgtgcagcctctggattcacctttgatgattatgccagcagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 485 - DNA, 369 bp, Homo sapiens
  source: /note="VH 1.73a"
gaggtgcagctggtggagtctgggggaggtgtggtacggcctggggggtccctgagactctcctgtgcagcctctggattcacctttgatgattatgcccggagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 486 - DNA, 369 bp, Homo sapiens
  source: /note="VH 1.74a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaattcgggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 487 - DNA, 369 bp, Homo sapiens
  source: /note="VH 1.75a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatcagggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 488 - DNA, 369 bp, Homo sapiens
  source: /note="VH 1.76a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatcacggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatgtgtttgatatctggggccaagggacaatggtcaccgtctcctca

SEQ ID NO: 489 - DNA, 369 bp, Homo sapiens
  source: /note="VH 1.77a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatgccggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 490 - DNA, 369 bp, Homo sapiens
  source: /note="VH 1.78a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatgtgtttgatatctggggccaagggacaatggtcaccgtctcctca

SEQ ID NO: 491 - DNA, 369 bp, Homo sapiens
  source: /note="VH 1.79a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 492 - DNA, 369 bp, Homo sapiens
  source: /note="VH 1.80a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaataagggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 493 - DNA, 369 bp, Homo sapiens
  source: /note="VH 1.81a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatcgcggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 494 - DNA, 369 bp, Homo sapiens
  source: /note="VH 1.82a"
gaggtgcagctggtggagtctgggggaggtgtggtacggcctggggggtccctgagactctcctgtgcagcctctggattcacctttgatgattatgccatcagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 495 - DNA, 369 bp, Homo sapiens
  source: /note="VH 1.83a"
gaggtgcagctggtggagtctgggggaggtgtggtacggcctggggggtccctgagactctcctgtgcagcctctggattcacctttgatgattatgccaccagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 496 - DNA, 369 bp, Homo sapiens
  source: /note="VH 1.84a"
gaggtgcagctggtggagtctgggggaggtgtggtacggcctggggggtccctgagactctcctgtgcagcctctggattcacctttgatgattatgccaacagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 497 - DNA, 369 bp, Homo sapiens
  source: /note="VH 1.85a"
gaggtgcagctggtggagtctgggggaggtgtggtacggcctggggggtccctgagactctcctgtgcagcctctggattcacctttgatgattatgccgacagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 498 - DNA, 369 bp, Homo sapiens
  source: /note="VH 1.86a"
gaggtgcagctggtggagtctgggggaggtgtggtacggcctggggggtccctgagactctcctgtgcagcctctggattcacctttgatgattatgccagcagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 499 - DNA, 369 bp, Homo sapiens
  source: /note="VH 1.87a"
gaggtgcagctggtggagtctgggggaggtgtggtacggcctggggggtccctgagactctcctgtgcagcctctggattcacctttgatgattatgccctcagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 500 - DNA, 369 bp, Homo sapiens
  source: /note="VH 1.88a"
gaggtgcagctggtggagtctgggggaggtgtggtacggcctggggggtccctgagactctcctgtgcagcctctggattcacctttgatgattatgccgggagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 501 - DNA, 369 bp, Homo sapiens
  source: /note="VH 1.89a"
gaggtgcagctggtggagtctgggggaggtgtggtacggcctggggggtccctgagactctcctgtgcagcctctggattcacctttgatgattatgccgagagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 502 - DNA, 369 bp, Homo sapiens
  source: /note="VH 1.90a"
gaggtgcagctggtggagtctgggggaggtgtggtacggcctggggggtccctgagactctcctgtgcagcctctggattcacctttgatgattatgcctggagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 503 - DNA, 369 bp, Homo sapiens
  source: /note="VH 1.91a"
gaggtgcagctggtggagtctgggggaggtgtggtacggcctggggggtccctgagactctcctgtgcagcctctggattcacctttgatgattatgcccggagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 504 - DNA, 369 bp, Homo sapiens
  source: /note="VH 1.92a"
gaggtgcagctggtggagtctgggggaggtgtggtacggcctggggggtccctgagactctcctgtgcagcctctggattcacctttgatgattatgccttcagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 505 - DNA, 369 bp, Homo sapiens
  source: /note="VH 1.93a"
gaggtgcagctggtggagtctgggggaggtgtggtacggcctggggggtccctgagactctcctgtgcagcctctggattcacctttgatgattatgccgtgagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 506 - DNA, 369 bp, Homo sapiens
  source: /note="VH 1.94a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaccggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 507 - DNA, 369 bp, Homo sapiens
  source: /note="VH 1.95a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggtccggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 508 - DNA, 369 bp, Homo sapiens
  source: /note="VH 1.96a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggcccggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 509 - DNA, 369 bp, Homo sapiens
  source: /note="VH 1.97a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggatcggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 510 - DNA, 369 bp, Homo sapiens
  source: /note="VH 1.98a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggctgggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 511 - DNA, 369 bp, Homo sapiens
  source: /note="VH 1.99a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatggtggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 512 - DNA, 369 bp, Homo sapiens
  source: /note="VH 1.100a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaagggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 513 - DNA, 369 bp, Homo sapiens
  source: /note="VH 1.101a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggcggggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatggttttgatatctggggccaagggacaatggtcaccgtctcctca

SEQ ID NO: 514 - DNA, 369 bp, Homo sapiens
  source: /note="VH 1.102a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatgtgtttgatatctggggccaagggacaatggtcaccgtctcctca

SEQ ID NO: 515 - DNA, 369 bp, Homo sapiens
  source: /note="VH 1.103a"
gaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatggtggtagcacaggttatgcagactctgtgaaggaccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 516 - protein, 5 aa, Homo sapiens
  source: /note="CDR1 sequence of SEQ ID NO: 519"
DYTMT

SEQ ID NO: 517 - protein, 17 aa, Homo sapiens
  source: /note="CDR2 sequence of SEQ ID NO: 519"
YISTGGTIKYYTDSVKG

SEQ ID NO: 518 - protein, 16 aa, Homo sapiens
  source: /note="CDR3 sequence of SEQ ID NO: 519"
EAPLRLGESPHDAFDI

SEQ ID NO: 519 - protein, 125 aa, Homo sapiens
  source: /note="VH 1.1b"
QVQLVESGGGLVKPGGSLRLSCAASGFTFSDYTMTWMRQAPGKGLEWVSYISTGGTIKYYTDSVKGRFTISRDNAKNSLYLQMNSLRADDTAVYYCAREAPLRLGESPHDAFDIWGQGTMVTVSS

SEQ ID NO: 520 - protein, 5 aa, Homo sapiens
  source: /note="CDR1 sequence of SEQ ID NO: 523"
DYTMT

SEQ ID NO: 521 - protein, 17 aa, Homo sapiens
  source: /note="CDR2 sequence of SEQ ID NO: 523"
YISTGGSIKYYTDSVKG

SEQ ID NO: 522 - protein, 16 aa, Homo sapiens
  source: /note="CDR3 sequence of SEQ ID NO: 523"
EAPLRLGESPHDAFDI

SEQ ID NO: 523 - protein, 125 aa, Homo sapiens
  source: /note="VH 1.2b"
EVQLLESGGGLVKPGGSLRLSCAASGFTFSDYTMTWMRQAPGKGLEWVSYISTGGSIKYYTDSVKGRFTISRDNAKNSLYLQMNSLRADDTAVYYCAREAPLRLGESPHDAFDIWGQGTMVTVSS

SEQ ID NO: 524 - protein, 5 aa, Homo sapiens
  source: /note="CDR1 sequence of SEQ ID NO: 527"
DYTMT

SEQ ID NO: 525 - protein, 17 aa, Homo sapiens
  source: /note="CDR2 sequence of SEQ ID NO: 527"
YISTGGSIKYYTDSVKG

SEQ ID NO: 526 - protein, 16 aa, Homo sapiens
  source: /note="CDR3 sequence of SEQ ID NO: 527"
EAPLRLGESPHDAFDI

SEQ ID NO: 527 - protein, 125 aa, Homo sapiens
  source: /note="VH 1.3b"
QVQLVESGGGLVKPGGSLRLSCAASGFTFSDYTMTWMRQAPGKGLEWVSYISTGGSIKYYTDSVKGRFTISRDNAKNSLYLQMNSLRADDTAVYYCAREAPLRLGESPHDAFDIWGQGTMVTVSS

SEQ ID NO: 528 - protein, 5 aa, Homo sapiens
  source: /note="CDR1 sequence of SEQ ID NO: 531"
DYYMI

SEQ ID NO: 529 - protein, 17 aa, Homo sapiens
  source: /note="CDR2 sequence of SEQ ID NO: 531"
YISGGGTTKYYTDSVKG

SEQ ID NO: 530 - protein, 16 aa, Homo sapiens
  source: /note="CDR3 sequence of SEQ ID NO: 531"
EAPLRLGETPHDAFDI

SEQ ID NO: 531 - protein, 125 aa, Homo sapiens
  source: /note="VH 1.4b"
QVQLVESGGGLVKPGGSLRLSCAASGFTFSDYYMIWMRQAPGKGLEWVSYISGGGTTKYYTDSVKGRFTISRDNAKNSLYLQMNSLRADDTAVYYCAREAPLRLGETPHDAFDIWGQGTMVTVSS

SEQ ID NO: 532 - protein, 5 aa, Homo sapiens
  source: /note="CDR1 sequence of SEQ ID NO: 535"
DYTMT

SEQ ID NO: 533 - protein, 17 aa, Homo sapiens
  source: /note="CDR2 sequence of SEQ ID NO: 535"
YISTGGNTKYYTDSVKG

SEQ ID NO: 534 - protein, 16 aa, Homo sapiens
  source: /note="CDR3 sequence of SEQ ID NO: 535"
EAPLRLGESPHDAFDI

SEQ ID NO: 535 - protein, 125 aa, Homo sapiens
  source: /note="VH 1.5b"
EVQLVESGGGLVKPGGSLRLSCAASGFTFSDYTMTWMRQAPGKGLEWVSYISTGGNTKYYTDSVKGRFTISRDNAKNSLYLQMNSLRADDTAVYYCAREAPLRLGESPHDAFDIWGQGTMVTVSS

SEQ ID NO: 536 - protein, 5 aa, Homo sapiens
  source: /note="CDR1 sequence of SEQ ID NO: 539"
DYTMT

SEQ ID NO: 537 - protein, 17 aa, Homo sapiens
  source: /note="CDR2 sequence of SEQ ID NO: 539"
YISTGGTIKYYTDSVKG

SEQ ID NO: 538 - protein, 16 aa, Homo sapiens
  source: /note="CDR3 sequence of SEQ ID NO: 539"
EAPLRLGESPHDAFDI

SEQ ID NO: 539 - protein, 125 aa, Homo sapiens
  source: /note="VH 1.6b"
EVQLLESGGGLVKPGGSLRLSCAASGFTFSDYTMTWMRQAPGKGLEWVSYISTGGTIKYYTDSVKGRFTISRDNAKNSLYLQMSSLRADDTAVYYCAREAPLRLGESPHDAFDIWGQGTMVTVSS

SEQ ID NO: 540 - protein, 5 aa, Homo sapiens
  source: /note="CDR1 sequence of SEQ ID NO: 543"
DYTMT

SEQ ID NO: 541 - protein, 17 aa, Homo sapiens
  source: /note="CDR2 sequence of SEQ ID NO: 543"
YISTGGTIKYYTDSVKG

SEQ ID NO: 542 - protein, 16 aa, Homo sapiens
  source: /note="CDR3 sequence of SEQ ID NO: 543"
EAPLRLGESPHDAFDI

SEQ ID NO: 543 - protein, 125 aa, Homo sapiens
  source: /note="VH 1.7b"
EVQLVESGGGLVKPGGSLRLSCAASGFTFSDYTMTWMRQAPGKGLEWVSYISTGGTIKYYTDSVKGRFTISRDNAKNSLYLQMNSLRADDTAVYYCAREAPLRLGESPHDAFDIWGQGTMVTVSS

SEQ ID NO: 544 - protein, 5 aa, Homo sapiens
  source: /note="CDR1 sequence of SEQ ID NO: 547"
DYTMT

SEQ ID NO: 545 - protein, 17 aa, Homo sapiens
  source: /note="CDR2 sequence of SEQ ID NO: 547"
YISTGGSIKYYTDSVKG

SEQ ID NO: 546 - protein, 16 aa, Homo sapiens
  source: /note="CDR3 sequence of SEQ ID NO: 547"
EAPLRLGESPHDAFDI

SEQ ID NO: 547 - protein, 125 aa, Homo sapiens
  source: /note="VH 1.8b"
EVQLVESGGGLVKPGGSLRLSCAASGFTFSDYTMTWMRQAPGKGLEWVSYISTGGSIKYYTDSVKGRFTISRDNAKNSLYLQMNSLRAGDTAVYYCAREAPLRLGESPHDAFDIWGQGTMVTVSS

SEQ ID NO: 548 - protein, 5 aa, Homo sapiens
  source: /note="CDR1 sequence of SEQ ID NO: 551"
DYTMT

SEQ ID NO: 549 - protein, 17 aa, Homo sapiens
  source: /note="CDR2 sequence of SEQ ID NO: 551"
YISTGGTIKYYTDSVKG

SEQ ID NO: 550 - protein, 16 aa, Homo sapiens
  source: /note="CDR3 sequence of SEQ ID NO: 551"
EAPLRLGESPHDAFDI

SEQ ID NO: 551 - protein, 125 aa, Homo sapiens
  source: /note="VH 1.9b"
QVQLVESGGGLVKPGGSLRLSCAASGFTFGDYTMTWMRQAPGKGLEWVSYISTGGTIKYYTDSVKGRFTISRDNAKNSLYLQMDSLRADDTAVYYCAREAPLRLGESPHDAFDIWGQGTMVTVSS

SEQ ID NO: 552 - protein, 5 aa, Homo sapiens
  source: /note="CDR1 sequence of SEQ ID NO: 555"
DYTMS

SEQ ID NO: 553 - protein, 17 aa, Homo sapiens
  source: /note="CDR2 sequence of SEQ ID NO: 555"
YISLGGNTKYYTDSVKG

SEQ ID NO: 554 - protein, 16 aa, Homo sapiens
  source: /note="CDR3 sequence of SEQ ID NO: 555"
EAPLRLGESPHDAFDI

SEQ ID NO: 555 - protein, 125 aa, Homo sapiens
  source: /note="VH 1.10b"
QVQLVESGGGLVKPGGSLRLSCAASGFTFSDYTMSWMRQAPGKGLEWISYISLGGNTKYYTDSVKGRFTISRDNAKNSLYLQMNSLRADDTAVYYCAREAPLRLGESPHDAFDIWGQGTMVTVSS

SEQ ID NO: 556 - protein, 5 aa, Homo sapiens
  source: /note="CDR1 sequence of SEQ ID NO: 559"
DYDMT

SEQ ID NO: 557 - protein, 17 aa, Homo sapiens
  source: /note="CDR2 sequence of SEQ ID NO: 559"
YISRGGSTKYYADSVKG

SEQ ID NO: 558 - protein, 16 aa, Homo sapiens
  source: /note="CDR3 sequence of SEQ ID NO: 559"
EAPLRLGETPHDAFDI

SEQ ID NO: 559 - protein, 125 aa, Homo sapiens
  source: /note="VH 1.11b"
EVQLLESGGGLVKPGGSLRLSCAASGFTFSDYDMTWIRQAPGKGQEWVSYISRGGSTKYYADSVKGRFTISRDNAKNSLYLQMNSLRAEDTAVYYCAREAPLRLGETPHDAFDIWGQGTMVTVSS

SEQ ID NO: 560 - protein, 5 aa, Homo sapiens
  source: /note="CDR1 sequence of SEQ ID NO: 563"
DYYMG

SEQ ID NO: 561 - protein, 17 aa, Homo sapiens
  source: /note="CDR2 sequence of SEQ ID NO: 563"
YISSSGSTIYYADSVKG

SEQ ID NO: 562 - protein, 16 aa, Homo sapiens
  source: /note="CDR3 sequence of SEQ ID NO: 563"
EAPLRLGESPHDAFDI

SEQ ID NO: 563 - protein, 125 aa, Homo sapiens
  source: /note="VH 1.12b"
EVQLLESGGGVVKPGGSLRLSCAASGFTFSDYYMGWIRQAPGKGLEWISYISSSGSTIYYADSVKGRFTISRDNAKNSLYLQMNSLRAEDTAVYYCAREAPLRLGESPHDAFDIWGQGTMVTVSS

SEQ ID NO: 564 - protein, 5 aa, Homo sapiens
  source: /note="CDR1 sequence of SEQ ID NO: 567"
DYTMT

SEQ ID NO: 565 - protein, 17 aa, Homo sapiens
  source: /note="CDR2 sequence of SEQ ID NO: 567"
YISTGGTIKYYTDSVKG

SEQ ID NO: 566 - protein, 16 aa, Homo sapiens
  source: /note="CDR3 sequence of SEQ ID NO: 567"
EAPLRLGESPHDAFDI

SEQ ID NO: 567 - protein, 125 aa, Homo sapiens
  source: /note="VH 1.13b"
EVQLLESGGGLVKPGGSLRLSCAASGFTFSDYTMTWMRQAPGKGLEWVSYISTGGTIKYYTDSVKGRFTISRDNAKNSLYLQMNSLRADDTAVYYCAREAPLRLGESPHDAFDIWGQGTMVTVSS

SEQ ID NO: 568 - protein, 5 aa, Homo sapiens
  source: /note="CDR1 sequence of SEQ ID NO: 571"
DYTMT

SEQ ID NO: 569 - protein, 17 aa, Homo sapiens
  source: /note="CDR2 sequence of SEQ ID NO: 571"
YISTGGTIKYYTDSVKG

SEQ ID NO: 570 - protein, 16 aa, Homo sapiens
  source: /note="CDR3 sequence of SEQ ID NO: 571"
EAPLRLGESPHDAFDI

SEQ ID NO: 571 - protein, 125 aa, Homo sapiens
  source: /note="VH 1.14b"
EVQLVESGGGLVQPGRSLRLSCAASGFTFSDYTMTWMRQAPGKGLEWVSYISTGGTIKYYTDSVKGRFTISRDNAKNSLYLQMNSLRADDTAVYYCAREAPLRLGESPHDAFDIWGQGTMVTVSS

SEQ ID NO: 572 - protein, 5 aa, Homo sapiens
  source: /note="CDR1 sequence of SEQ ID NO: 575"
DNSMS

SEQ ID NO: 573 - protein, 17 aa, Homo sapiens
  source: /note="CDR2 sequence of SEQ ID NO: 575"
YISSSGSTIYYADSVKG

SEQ ID NO: 574 - protein, 16 aa, Homo sapiens
  source: /note="CDR3 sequence of SEQ ID NO: 575"
EAPLRLGESPHDAFDI

SEQ ID NO: 575 - protein, 125 aa, Homo sapiens
  source: /note="VH 1.15b"
QVQLVESGGGLVKPGGSLRLSCAASGFTFSDNSMSWIRQAPGKGLEWVSYISSSGSTIYYADSVKGRFTISRDNAKNSLYLQMNTLRAEDTAVYYCAKEAPLRLGESPHDAFDIWGQGTMVTVSS

SEQ ID NO: 576 - protein, 5 aa, Homo sapiens
  source: /note="CDR1 sequence of SEQ ID NO: 579"
DYTMS

SEQ ID NO: 577 - protein, 17 aa, Homo sapiens
  source: /note="CDR2 sequence of SEQ ID NO: 579"
YISTGGSIKYYTDSVKG

SEQ ID NO: 578 - protein, 16 aa, Homo sapiens
  source: /note="CDR3 sequence of SEQ ID NO: 579"
EAPLRLGESPHDAFDI

SEQ ID NO: 579 - protein, 125 aa, Homo sapiens
  source: /note="VH 1.16b"
EVQLVESGGGLVKPGGSLRLSCAASGFTFSDYTMSWMRQAPGKGLEWVSYISTGGSIKYYTDSVKGRFTISRDNAKNSLYLQMNSLRADDTAVYYCAREAPLRLGESPHDAFDIWGQGTMVTVSS

SEQ ID NO: 580 - protein, 5 aa, Homo sapiens
  source: /note="CDR1 sequence of SEQ ID NO: 583"
DYTMT

SEQ ID NO: 581 - protein, 17 aa, Homo sapiens
  source: /note="CDR2 sequence of SEQ ID NO: 583"
YISTGGSIKYYTDSVKG

SEQ ID NO: 582 - protein, 16 aa, Homo sapiens
  source: /note="CDR3 sequence of SEQ ID NO: 583"
EAPLRLGESPHDAFDI

SEQ ID NO: 583 - protein, 125 aa, Homo sapiens
  source: /note="VH 1.17b"
EVQLVESGGGLVKPGGSLRLSCAASGFTFSDYTMTWMRQAPGKGLEWVSYISTGGSIKYYTDSVKGRFTISRDNAKNSLYLQMNSLRVDDTAVYYCAREAPLRLGESPHDAFDIWGQGTMVTVSS

SEQ ID NO: 584 - protein, 5 aa, Homo sapiens
  source: /note="CDR1 sequence of SEQ ID NO: 587"
DYTMT

SEQ ID NO: 585 - protein, 17 aa, Homo sapiens
  source: /note="CDR2 sequence of SEQ ID NO: 587"
YISTGGTIKYYTDSVKG

SEQ ID NO: 586 - protein, 16 aa, Homo sapiens
  source: /note="CDR3 sequence of SEQ ID NO: 587"
EAPLRLGESPHDAFDI

SEQ ID NO: 587 - protein, 125 aa, Homo sapiens
  source: /note="VH 1.18b"
QVQLLESGGGLVKPGGSLRLSCAASGFTFSDYTMTWMRQAPGKGLEWVSYISTGGTIKYYTDSVKGRFTISRDNAKNSLYLQMNSLRADDTAVYYCAREAPLRLGESPHDAFDIWGQGTMVTVSS

SEQ ID NO: 588 - protein, 5 aa, Homo sapiens
  source: /note="CDR1 sequence of SEQ ID NO: 591"
DYTMT

SEQ ID NO: 589 - protein, 17 aa, Homo sapiens
  source: /note="CDR2 sequence of SEQ ID NO: 591"
YISTGGSIKYYTDSVKG

SEQ ID NO: 590 - protein, 16 aa, Homo sapiens
  source: /note="CDR3 sequence of SEQ ID NO: 591"
EAPLRLGETPHDAFDI

SEQ ID NO: 591 - protein, 125 aa, Homo sapiens
  source: /note="VH 1.19b"
QVQLVESGGGLVKPGGSLRLSCAASGFTFSDYTMTWMRQAPGKGLEWVSYISTGGSIKYYTDSVKGRFTISRDNAKNSLYLQMNSLRAEDTAVYYCAREAPLRLGETPHDAFDIWGQGTMVTVSS

SEQ ID NO: 592 - protein, 5 aa, Homo sapiens
  source: /note="CDR1 sequence of SEQ ID NO: 595"
DYTMT

SEQ ID NO: 593 - protein, 17 aa, Homo sapiens
  source: /note="CDR2 sequence of SEQ ID NO: 595"
YISSGGSIKFYADSVKG

SEQ ID NO: 594 - protein, 16 aa, Homo sapiens
  source: /note="CDR3 sequence of SEQ ID NO: 595"
EAPLRLGESPHDAFDI

SEQ ID NO: 595 - protein, 125 aa, Homo sapiens
  source: /note="VH 1.20b"
EVQLLESGGGLVKPGGSLRLSCAASGFTFSDYTMTWMRQAPGKGLEWVSYISSGGSIKFYADSVKGRFTISRDNAKNSLYLQMNSLRAEDTAVYYCAREAPLRLGESPHDAFDIWGQGTMVTVSS

SEQ ID NO: 596 - protein, 5 aa, Homo sapiens
  source: /note="CDR1 sequence of SEQ ID NO: 599"
DYTMT

SEQ ID NO: 597 - protein, 17 aa, Homo sapiens
  source: /note="CDR2 sequence of SEQ ID NO: 599"
YISTGGSIKYYTDSVKG

SEQ ID NO: 598 - protein, 16 aa, Homo sapiens
  source: /note="CDR3 sequence of SEQ ID NO: 599"
EAPLRLGESPHDAFDT

SEQ ID NO: 599 - protein, 125 aa, Homo sapiens
  source: /note="VH 1.21b"
EVQLVESGGGLVKPGGSLRLSCAASGFTFSDYTMTWMRQAPGKGLEWVSYISTGGSIKYYTDSVKGRFTISRDNAKNSLYLQMNSLRADDTAVYYCAREAPLRLGESPHDAFDTWGQGTMVTVSS

SEQ ID NO: 600 - protein, 5 aa, Homo sapiens
  source: /note="CDR1 sequence of SEQ ID NO: 603"
DYTMT

SEQ ID NO: 601 - protein, 17 aa, Homo sapiens
  source: /note="CDR2 sequence of SEQ ID NO: 603"
YISTGGSIKYYTDSVKG

SEQ ID NO: 602 - protein, 16 aa, Homo sapiens
  source: /note="CDR3 sequence of SEQ ID NO: 603"
EAPLRLGESPHDAFDI

SEQ ID NO: 603 - protein, 125 aa, Homo sapiens
  source: /note="VH 1.22b"
EVQLVESGGGLVKPGGSLRLSCAASGFTFSDYTMTWMRQAPGKGLEWVSYISTGGSIKYYTDSVKGRFTISRDNAKNSLYLQMNSLRADDTAVYYCAREAPLRLGESPHDAFDIWGQGTMVTVSS

SEQ ID NO: 604 - protein, 5 aa, Homo sapiens
  source: /note="CDR1 sequence of SEQ ID NO: 607"
DYTMS

SEQ ID NO: 605 - protein, 17 aa, Homo sapiens
  source: /note="CDR2 sequence of SEQ ID NO: 607"
YISTGGTIKYYTDSVKG

SEQ ID NO: 606 - protein, 16 aa, Homo sapiens
  source: /note="CDR3 sequence of SEQ ID NO: 607"
EAPLRLGESPHDAFDI

SEQ ID NO: 607 - protein, 125 aa, Homo sapiens
  source: /note="VH 1.23b"
QITLKESGGGLVKPGGSLRLSCAASGFTFSDYTMSWMRQAPGKGLEWVSYISTGGTIKYYTDSVKGRFTISRDNAKNSLYLQMNSLRADDTAVYYCAREAPLRLGESPHDAFDIWGQGTMVTVSS

SEQ ID NO: 608 - protein, 5 aa, Homo sapiens
  source: /note="CDR1 sequence of SEQ ID NO: 611"
DYDMY

SEQ ID NO: 609 - protein, 17 aa, Homo sapiens
  source: /note="CDR2 sequence of SEQ ID NO: 611"
YISRGGSVTYYADSVKG

SEQ ID NO: 610 - protein, 16 aa, Homo sapiens
  source: /note="CDR3 sequence of SEQ ID NO: 611"
EAPLRLGETPHAAFDI

SEQ ID NO: 611 - protein, 125 aa, Homo sapiens
  source: /note="VH 1.24b"
QVTLKESGGGLVKPGGSLRLSCAASGFTFSDYDMYWIRQAPGKGLEWVSYISRGGSVTYYADSVKGRFTISRDNAKNALYLQMNSLRAEDMAVYFCATEAPLRLGETPHAAFDIWGQGTMVTVSS

SEQ ID NO: 612 - protein, 5 aa, Homo sapiens
  source: /note="CDR1 sequence of SEQ ID NO: 615"
DYYMS

SEQ ID NO: 613 - protein, 17 aa, Homo sapiens
  source: /note="CDR2 sequence of SEQ ID NO: 615"
FISSSGSTTYYADSVKG

SEQ ID NO: 614 - protein, 16 aa, Homo sapiens
  source: /note="CDR3 sequence of SEQ ID NO: 615"
EAPLRLGESPHDAFDF

SEQ ID NO: 615 - protein, 125 aa, Homo sapiens
  source: /note="VH 1.25b"
QVTLKESGGGLVKPGGSLRLSCAASGFTFSDYYMSWFRQAPGKEREWISFISSSGSTTYYADSVKGRFTISRDNAKNSLYLQMNSLRAEDTAVYYCAREAPLRLGESPHDAFDFWGQGTMVTVSS

SEQ ID NO: 616 - protein, 5 aa, Homo sapiens
  source: /note="CDR1 sequence of SEQ ID NO: 619"
DNSMS

SEQ ID NO: 617 - protein, 17 aa, Homo sapiens
  source: /note="CDR2 sequence of SEQ ID NO: 619"
YISSSGSTIYYADSVKG

SEQ ID NO: 618 - protein, 16 aa, Homo sapiens
  source: /note="CDR3 sequence of SEQ ID NO: 619"
EAPLRLGESPHDAFDI

SEQ ID NO: 619 - protein, 125 aa, Homo sapiens
  source: /note="VH 1.26b"
QVTLKESGGGLVKPGGSLRLSCAASGFTFSDNSMSWIRQAPGKGLEWVSYISSSGSTIYYADSVKGRFTISRDNAKNSLYLQMNTLRAEDTAVYYCAKEAPLRLGESPHDAFDIWGQGTMVTVSS

SEQ ID NO: 620 - protein, 5 aa, Homo sapiens
  source: /note="CDR1 sequence of SEQ ID NO: 623"
DYTMT

SEQ ID NO: 621 - protein, 17 aa, Homo sapiens
  source: /note="CDR2 sequence of SEQ ID NO: 623"
YISTGGSIKYYTDSVKG

SEQ ID NO: 622 - protein, 16 aa, Homo sapiens
  source: /note="CDR3 sequence of SEQ ID NO: 623"
EAPLRLGESPHDAFDI

SEQ ID NO: 623 - protein, 125 aa, Homo sapiens
  source: /note="VH 1.27b"
QVTLKESGGGLVKPGGSLRLSCAASGFTFSDYTMTWMRQAPGKGLEWVSYISTGGSIKYYTDSVKGRFTISRDNAKNSLYLQMNSLRADDTAVYYCAREAPLRLGESPHDAFDIWGQGTMVTVSS

SEQ ID NO: 624 - protein, 5 aa, Homo sapiens
  source: /note="CDR1 sequence of SEQ ID NO: 627"
DYDMY

SEQ ID NO: 625 - protein, 17 aa, Homo sapiens
  source: /note="CDR2 sequence of SEQ ID NO: 627"
YISRGGSVTYYADSVKG

SEQ ID NO: 626 - protein, 16 aa, Homo sapiens
  source: /note="CDR3 sequence of SEQ ID NO: 627"
EAPLRLGETPHAAFDI

SEQ ID NO: 627 - protein, 125 aa, Homo sapiens
  source: /note="VH 1.28b"
QITLKESGGGLVKPGGSLRLSCAASGFTFSDYDMYWIRQAPGKGLEWVSYISRGGSVTYYADSVKGRFTISRDNAKNALYLQMNSLRAEDMAVYFCATEAPLRLGETPHAAFDIWGQGTMVTVSS

SEQ ID NO: 628 - protein, 5 aa, Homo sapiens
  source: /note="CDR1 sequence of SEQ ID NO: 631"
DYTMS

SEQ ID NO: 629 - protein, 17 aa, Homo sapiens
  source: /note="CDR2 sequence of SEQ ID NO: 631"
YISTGGTIKYYTDSVKG

SEQ ID NO: 630 - protein, 16 aa, Homo sapiens
  source: /note="CDR3 sequence of SEQ ID NO: 631"
EAPLRLGESPHDAFDI

SEQ ID NO: 631 - protein, 125 aa, Homo sapiens
  source: /note="VH 1.29b"
QVTLKESGGGLVKPGGSLRLSCAASGFTFSDYTMSWMRQAPGKGLEWVSYISTGGTIKYYTDSVKGRFTISRDNAKNSLYLQMNSLRADDTAVYYCAREAPLRLGESPHDAFDIWGQGTMVTVSS

SEQ ID NO: 632 - protein, 5 aa, Homo sapiens
  source: /note="CDR1 sequence of SEQ ID NO: 635"
DYTMT

SEQ ID NO: 633 - protein, 17 aa, Homo sapiens
  source: /note="CDR2 sequence of SEQ ID NO: 635"
YISTGGSIKYYTDSVKG

SEQ ID NO: 634 - protein, 16 aa, Homo sapiens
  source: /note="CDR3 sequence of SEQ ID NO: 635"
EAPLRLGESPHDAFDI

SEQ ID NO: 635 - protein, 125 aa, Homo sapiens
  source: /note="VH 1.30b"
QVTLKESGGGLVKPGGSLRLSCAASGFTFSDYTMTWMRQAPGKGLEWVSYISTGGSIKYYTDSVKGRFTISRDNARNSLYLQMNSLRAEDTAVYYCAREAPLRLGESPHDAFDIWGQGTMVTVSS

SEQ ID NO: 636 - protein, 5 aa, Homo sapiens
  source: /note="CDR1 sequence of SEQ ID NO: 639"
DYTMT

SEQ ID NO: 637 - protein, 17 aa, Homo sapiens
  source: /note="CDR2 sequence of SEQ ID NO: 639"
YISTGGSTKYYTDSVKG

SEQ ID NO: 638 - protein, 16 aa, Homo sapiens
  source: /note="CDR3 sequence of SEQ ID NO: 639"
EAPLRLGESPHDAFDI

SEQ ID NO: 639 - protein, 125 aa, Homo sapiens
  source: /note="VH 1.31b"
QVTLKESGGGLVKPGGSLRLSCAASGFTFSDYTMTWMRQAPGKGLEWVSYISTGGSTKYYTDSVKGRFTISRDNAKNSLYLQMNSLRADDTAVYYCAREAPLRLGESPHDAFDIWGQGTMVTVSS

SEQ ID NO: 640 - protein, 5 aa, Homo sapiens
  source: /note="CDR1 sequence of SEQ ID NO: 643"
DDYMM

SEQ ID NO: 641 - protein, 17 aa, Homo sapiens
  source: /note="CDR2 sequence of SEQ ID NO: 643"
YISSGGSIIYYADSVKG

SEQ ID NO: 642 - protein, 16 aa, Homo sapiens
  source: /note="CDR3 sequence of SEQ ID NO: 643"
EAPLRLGESPHDAFDI

SEQ ID NO: 643 - protein, 125 aa, Homo sapiens
  source: /note="VH 1.32b"
QVTLKESGGGLVKPGGSLRLSCAASGFTFSDDYMMWIRQAPGKGLEWVSYISSGGSIIYYADSVKGRFTISRDNAKNSLYLQMNSLRAEDTAVYYCAREAPLRLGESPHDAFDIRGQGTMVTVSS

SEQ ID NO: 644 - protein, 5 aa, Homo sapiens
  source: /note="CDR1 sequence of SEQ ID NO: 647"
DYDMY

SEQ ID NO: 645 - protein, 17 aa, Homo sapiens
  source: /note="CDR2 sequence of SEQ ID NO: 647"
YISRGGSVTYYADSVKG

SEQ ID NO: 646 - protein, 16 aa, Homo sapiens
  source: /note="CDR3 sequence of SEQ ID NO: 647"
EAPLRLGETPHAAFDI

SEQ ID NO: 647 - protein, 125 aa, Homo sapiens
  source: /note="VH 1.33b"
QITLKESGGGLVKPGGSLRLSCAASGFTFSDYDMYWVRQAPGKGLEWVSYISRGGSVTYYADSVKGRFTISRDNAKNALYLQMNSLRAEDMAVYFCATEAPLRLGETPHAAFDIWGQGTMVTVSS

SEQ ID NO: 648 - protein, 5 aa, Homo sapiens
  source: /note="CDR1 sequence of SEQ ID NO: 651"
DYTMT

SEQ ID NO: 649 - protein, 17 aa, Homo sapiens
  source: /note="CDR2 sequence of SEQ ID NO: 651"
YISTGGSVKYYTDSVKG

SEQ ID NO: 650 - protein, 16 aa, Homo sapiens
  source: /note="CDR3 sequence of SEQ ID NO: 651"
EAPLRLGESPHDAFDI

SEQ ID NO: 651 - protein, 125 aa, Homo sapiens
  source: /note="VH 1.34b"
EVQLVESGGGLVKPGGSLRLSCAASGFTFSDYTMTWMRQAPGKGLEWVSYISTGGSVKYYTDSVKGRFTISRDNAKNSLYLQMNSLRADDTAVYYCAREAPLRLGESPHDAFDIWGQGTMVTVSS

SEQ ID NO: 652 - protein, 5 aa, Homo sapiens
  source: /note="CDR1 sequence of SEQ ID NO: 655"
DYTMT

SEQ ID NO: 653 - protein, 17 aa, Homo sapiens
  source: /note="CDR2 sequence of SEQ ID NO: 655"
YISTGGSIKYYTDSVKG

SEQ ID NO: 654 - protein, 16 aa, Homo sapiens
  source: /note="CDR3 sequence of SEQ ID NO: 655"
EAPLRLGESPHDAFDI

SEQ ID NO: 655 - protein, 125 aa, Homo sapiens
  source: /note="VH 1.35b"
EVQLLESGGGLVKPGGSLRLSCAASGFTFSDYTMTWMRQAPGKGLEWVSYISTGGSIKYYTDSVKGRFTISRDNAKNSLYLQMNSLRVDDTAVYYCAREAPLRLGESPHDAFDIWGQGTMVTVSS

SEQ ID NO: 656 - protein, 5 aa, Homo sapiens
  source: /note="CDR1 sequence of SEQ ID NO: 659"
DYTMT

SEQ ID NO: 657 - protein, 17 aa, Homo sapiens
  source: /note="CDR2 sequence of SEQ ID NO: 659"
YISTGGTIKYYTDSVKG

SEQ ID NO: 658 - protein, 16 aa, Homo sapiens
  source: /note="CDR3 sequence of SEQ ID NO: 659"
EAPLRLGESPHDAFDI

SEQ ID NO: 659 - protein, 125 aa, Homo sapiens
  source: /note="VH 1.36b"
EVQLVESGGGLVKPGGSLRLSCAASGFTFSDYTMTWMRQAPGKGLEWVSYISTGGTIKYYTDSVKGRFTISRDNAKNSLFLQMNSLRADDTAVYYCAREAPLRLGESPHDAFDIWGQGTMVTVSS

SEQ ID NO: 660 - protein, 5 aa, Homo sapiens
  source: /note="CDR1 sequence of SEQ ID NO: 663"
DYTMT

SEQ ID NO: 661 - protein, 17 aa, Homo sapiens
  source: /note="CDR2 sequence of SEQ ID NO: 663"
YISTGGSIKYYTDSVKG

SEQ ID NO: 662 - protein, 16 aa, Homo sapiens
  source: /note="CDR3 sequence of SEQ ID NO: 663"
EAPLRLGESPHDAFDI

SEQ ID NO: 663 - protein, 125 aa, Homo sapiens
  source: /note="VH 1.37b"
QVQLVESGGGLVKPGGSLRLSCAASGFTFSDYTMTWMRQAPGKGLEWVSYISTGGSIKYYTDSVKGRFTISRDNAKNSLFLQMNSLRADDTAVYYCAREAPLRLGESPHDAFDIWGQGTMVTVSS

SEQ ID NO: 664 - protein, 5 aa, Homo sapiens
  source: /note="CDR1 sequence of SEQ ID NO: 667"
DYTMT

SEQ ID NO: 665 - protein, 17 aa, Homo sapiens
  source: /note="CDR2 sequence of SEQ ID NO: 667"
YISTGGTIKYYTDSVKG

SEQ ID NO: 666 - protein, 16 aa, Homo sapiens
  source: /note="CDR3 sequence of SEQ ID NO: 667"
EAPLRLGESPHDAFDI

SEQ ID NO: 667 - protein, 125 aa, Homo sapiens
  source: /note="VH 1.38b"
EVQLVESGGGLVQPGGSLRLSCAASGFTFSDYTMTWMRQAPGKGLEWVSYISTGGTIKYYTDSVKGRFTISRDNAKNSLYLQMNSLRADDTAVYYCAREAPLRLGESPHDAFDIWGQGTMVTVSS

SEQ ID NO: 668 - protein, 5 aa, Homo sapiens
  source: /note="CDR1 sequence of SEQ ID NO: 671"
DYTMT

SEQ ID NO: 669 - protein, 17 aa, Homo sapiens
  source: /note="CDR2 sequence of SEQ ID NO: 671"
YISTGGSIKYYTDSVKG

SEQ ID NO: 670 - protein, 16 aa, Homo sapiens
  source: /note="CDR3 sequence of SEQ ID NO: 671"
EAPLRLGESPHDAFDI

SEQ ID NO: 671 - protein, 125 aa, Homo sapiens
  source: /note="VH 1.39b"
QVQLQESGGGLVKPGGSLRLSCAASGFTFSDYTMTWMRQAPGKGLEWVSYISTGGSIKYYTDSVKGRFTISRDNAKNSLYLQMNSLRADDTAVYYCAREAPLRLGESPHDAFDIWGQGTMVTVSS

SEQ ID NO: 672 - protein, 5 aa, Homo sapiens
  source: /note="CDR1 sequence of SEQ ID NO: 675"
DSSMS

SEQ ID NO: 673 - protein, 17 aa, Homo sapiens
  source: /note="CDR2 sequence of SEQ ID NO: 675"
YISSGGGIIYYTDSVKG

SEQ ID NO: 674 - protein, 16 aa, Homo sapiens
  source: /note="CDR3 sequence of SEQ ID NO: 675"
EAPLRLGESPHDAFDI

SEQ ID NO: 675 - protein, 125 aa, Homo sapiens
  source: /note="VH 1.40b"
EVQLVESGGGLVKPGGSLRLSCAASGFTFSDSSMSWIRQAPGRGLEWISYISSGGGIIYYTDSVKGRFTISRDNAKNSLYLQMNSLRVEDTAVYYCAKEAPLRLGESPHDAFDIWGHGTMVTVSS

SEQ ID NO: 676 - protein, 5 aa, Homo sapiens
  source: /note="CDR1 sequence of SEQ ID NO: 679"
DNSMT

SEQ ID NO: 677 - protein, 17 aa, Homo sapiens
  source: /note="CDR2 sequence of SEQ ID NO: 679"
YISSGGGVIFYADSVKG

SEQ ID NO: 678 - protein, 16 aa, Homo sapiens
  source: /note="CDR3 sequence of SEQ ID NO: 679"
EAPLRLGESPHDAFDI

SEQ ID NO: 679 - protein, 125 aa, Homo sapiens
  source: /note="VH 1.41b"
QVQLVESGGGLVKPGGSLRLSCAASGFTFSDNSMTWMRQAPGKGLEWVSYISSGGGVIFYADSVKGRFTISRDNAKNSLYLQMNSLRADDTAVYYCAREAPLRLGESPHDAFDIWGQGTMVTVSS

SEQ ID NO: 680 - protein, 5 aa, Homo sapiens
  source: /note="CDR1 sequence of SEQ ID NO: 683"
DNSMT

SEQ ID NO: 681 - protein, 17 aa, Homo sapiens
  source: /note="CDR2 sequence of SEQ ID NO: 683"
YISSGGGVKFYADSVKG

SEQ ID NO: 682 - protein, 16 aa, Homo sapiens
  source: /note="CDR3 sequence of SEQ ID NO: 683"
EAPLRLGESPHDAFDI

SEQ ID NO: 683 - protein, 125 aa, Homo sapiens
  source: /note="VH 1.42b"
QVQLVESGGGLVKPGGSLRLSCAASGFTFSDNSMTWMRQAPGKGLEWVSYISSGGGVKFYADSVKGRFTISRDNAKNSLYLQMNSLRADDTAVYYCAREAPLRLGESPHDAFDIWGQGTMVTVSS

SEQ ID NO: 684 - protein, 5 aa, Homo sapiens
  source: /note="CDR1 sequence of SEQ ID NO: 687"
DSSMT

SEQ ID NO: 685 - protein, 17 aa, Homo sapiens
  source: /note="CDR2 sequence of SEQ ID NO: 687"
YISSGGGVIFYADSVKG

SEQ ID NO: 686 - protein, 16 aa, Homo sapiens
  source: /note="CDR3 sequence of SEQ ID NO: 687"
EAPLRLGESPHDAFDI

SEQ ID NO: 687 - protein, 125 aa, Homo sapiens
  source: /note="VH 1.43b"
QVQLVESGGGLVKPGGSLRLSCAASGFTFSDSSMTWMRQAPGKGLEWVSYISSGGGVIFYADSVKGRFTISRDNAKNSLYLQMNSLRADDTAVYYCAREAPLRLGESPHDAFDIWGQGTMVTVSS

SEQ ID NO: 688 - protein, 5 aa, Homo sapiens
  source: /note="CDR1 sequence of SEQ ID NO: 691"
DNSMT

SEQ ID NO: 689 - protein, 17 aa, Homo sapiens
  source: /note="CDR2 sequence of SEQ ID NO: 691"
YISSGGAVKFYADSVKG

SEQ ID NO: 690 - protein, 16 aa, Homo sapiens
  source: /note="CDR3 sequence of SEQ ID NO: 691"
EAPLRLGESPHDAFDI

SEQ ID NO: 691 - protein, 125 aa, Homo sapiens
  source: /note="VH 1.44b"
QVQLVESGGGLVKPGGSLRLSCAASGFTFSDNSMTWMRQAPGKGLEWVSYISSGGAVKFYADSVKGRFTISRDNAKNSLYLQMNSLRADDTAVYYCAREAPLRLGESPHDAFDIWGQGTMVTVSS

SEQ ID NO: 692 - protein, 5 aa, Homo sapiens
  source: /note="CDR1 sequence of SEQ ID NO: 695"
DYSMS

SEQ ID NO: 693 - protein, 17 aa, Homo sapiens
  source: /note="CDR2 sequence of SEQ ID NO: 695"
YISSGGGVIFYADSVKG

SEQ ID NO: 694 - protein, 16 aa, Homo sapiens
  source: /note="CDR3 sequence of SEQ ID NO: 695"
EAPLRLGESPHDAFDI

SEQ ID NO: 695 - protein, 125 aa, Homo sapiens
  source: /note="VH 1.45b"
QVQLVESGGGLVKPGGSLRLSCAASGFTFSDYSMSWMRQAPGKGLEWVSYISSGGGVIFYADSVKGRFTISRDNAKNSLYLQMNSLRADDTAVYYCAREAPLRLGESPHDAFDIWGQGTMVTVSS

SEQ ID NO: 696 - protein, 5 aa, Homo sapiens
  source: /note="CDR1 sequence of SEQ ID NO: 699"
DSSMS

SEQ ID NO: 697 - protein, 17 aa, Homo sapiens
  source: /note="CDR2 sequence of SEQ ID NO: 699"
YISSGGGVIFYADSVKG

SEQ ID NO: 698 - protein, 16 aa, Homo sapiens
  source: /note="CDR3 sequence of SEQ ID NO: 699"
EAPLRLGESPHDAFDI

SEQ ID NO: 699 - protein, 125 aa, Homo sapiens
  source: /note="VH 1.46b"
QVQLVESGGGLVKPGGSLRLSCAASGFTFSDSSMSWMRQAPGKGLEWVSYISSGGGVIFYADSVKGRFTISRDNAKNSLYLQMNSLRADDTAVYYCAREAPLRLGESPHDAFDIWGQGTMVTVSS

SEQ ID NO: 700 - protein, 5 aa, Homo sapiens
  source: /note="CDR1 sequence of SEQ ID NO: 703"
DNSMS

SEQ ID NO: 701 - protein, 17 aa, Homo sapiens
  source: /note="CDR2 sequence of SEQ ID NO: 703"
YISSGGGVIFYADSVKG

SEQ ID NO: 702 - protein, 16 aa, Homo sapiens
  source: /note="CDR3 sequence of SEQ ID NO: 703"
EAPLRLGESPHDAFDI

SEQ ID NO: 703 - protein, 125 aa, Homo sapiens
  source: /note="VH 1.47b"
QVQLVESGGGLVKPGGSLRLSCAASGFTFSDNSMSWMRQAPGKGLEWVSYISSGGGVIFYADSVKGRFTISRDNAKNSLYLQMNSLRADDTAVYYCAREAPLRLGESPHDAFDIWGQGTMVTVSS

SEQ ID NO: 704 - protein, 5 aa, Homo sapiens
  source: /note="CDR1 sequence of SEQ ID NO: 707"
DSSMT

SEQ ID NO: 705 - protein, 17 aa, Homo sapiens
  source: /note="CDR2 sequence of SEQ ID NO: 707"
YISSGGGVKFYADSVKG

SEQ ID NO: 706 - protein, 16 aa, Homo sapiens
  source: /note="CDR3 sequence of SEQ ID NO: 707"
EAPLRLGESPHDAFDI

SEQ ID NO: 707 - protein, 125 aa, Homo sapiens
  source: /note="VH 1.48b"
QVQLVESGGGLVKPGGSLRLSCAASGFTFSDSSMTWMRQAPGKGLEWVSYISSGGGVKFYADSVKGRFTISRDNAKNSLYLQMNSLRADDTAVYYCAREAPLRLGESPHDAFDIWGQGTMVTVSS

SEQ ID NO: 708 - protein, 5 aa, Homo sapiens
  source: /note="CDR1 sequence of SEQ ID NO: 711"
DSSMS

SEQ ID NO: 709 - protein, 17 aa, Homo sapiens
  source: /note="CDR2 sequence of SEQ ID NO: 711"
YISTGGGVKFYADSVKG

SEQ ID NO: 710 - protein, 16 aa, Homo sapiens
  source: /note="CDR3 sequence of SEQ ID NO: 711"
EAPLRLGESPHDAFDI

SEQ ID NO: 711 - protein, 125 aa, Homo sapiens
  source: /note="VH 1.49b"
QVQLVESGGGLVKPGGSLRLSCAASGFTFSDSSMSWMRQAPGKGLEWVSYISTGGGVKFYADSVKGRFTISRDNAKNSLYLQMNSLRADDTAVYYCAREAPLRLGESPHDAFDIWGQGTMVTVSS

SEQ ID NO: 712 - protein, 5 aa, Homo sapiens
  source: /note="CDR1 sequence of SEQ ID NO: 715"
DNSMT

SEQ ID NO: 713 - protein, 17 aa, Homo sapiens
  source: /note="CDR2 sequence of SEQ ID NO: 715"
YISSGGTIKFYADSVKG

SEQ ID NO: 714 - protein, 16 aa, Homo sapiens
  source: /note="CDR3 sequence of SEQ ID NO: 715"
EAPLRLGESPHDAFDI

SEQ ID NO: 715 - protein, 125 aa, Homo sapiens
  source: /note="VH 1.50b"
QVQLVESGGGLVKPGGSLRLSCAASGFTFSDNSMTWMRQAPGKGLEWVSYISSGGTIKFYADSVKGRFTISRDNAKNSLYLQMNSLRADDTAVYYCAREAPLRLGESPHDAFDIWGQGTMVTVSS

SEQ ID NO: 716 - protein, 5 aa, Homo sapiens
  source: /note="CDR1 sequence of SEQ ID NO: 719"
DSSMT

SEQ ID NO: 717 - protein, 17 aa, Homo sapiens
  source: /note="CDR2 sequence of SEQ ID NO: 719"
YISSGGAVKFYTDSVKG

SEQ ID NO: 718 - protein, 16 aa, Homo sapiens
  source: /note="CDR3 sequence of SEQ ID NO: 719"
EAPLRLGESPHDAFDI

SEQ ID NO: 719 - protein, 125 aa, Homo sapiens
  source: /note="VH 1.51b"
QVQLVESGGGLVKPGGSLRLSCAASGFTFSDSSMTWMRQAPGKGLEWVSYISSGGAVKFYTDSVKGRFTISRDNAKNSLYLQMNSLRADDTAVYYCAREAPLRLGESPHDAFDIWGQGTMVTVSS

SEQ ID NO: 720 - protein, 5 aa, Homo sapiens
  source: /note="CDR1 sequence of SEQ ID NO: 723"
DNSMT

SEQ ID NO: 721 - protein, 17 aa, Homo sapiens
  source: /note="CDR2 sequence of SEQ ID NO: 723"
YISSGGGVKYYADSVKG

SEQ ID NO: 722 - protein, 16 aa, Homo sapiens
  source: /note="CDR3 sequence of SEQ ID NO: 723"
EAPLRLGESPHDAFDI

SEQ ID NO: 723 - protein, 125 aa, Homo sapiens
  source: /note="VH 1.52b"
QVQLVESGGGLVKPGGSLRLSCAASGFTFSDNSMTWMRQAPGKGLEWVSYISSGGGVKYYADSVKGRFTISRDNAKNSLYLQMNSLRADDTAVYYCAREAPLRLGESPHDAFDIWGQGTMVTVSS

SEQ ID NO: 724 - protein, 5 aa, Homo sapiens
  source: /note="CDR1 sequence of SEQ ID NO: 727"
DNSMT

SEQ ID NO: 725 - protein, 17 aa, Homo sapiens
  source: /note="CDR2 sequence of SEQ ID NO: 727"
YISSGGSVKFYADSVKG

SEQ ID NO: 726 - protein, 16 aa, Homo sapiens
  source: /note="CDR3 sequence of SEQ ID NO: 727"
EAPLRLGESPHDAFDI

SEQ ID NO: 727 - protein, 125 aa, Homo sapiens
  source: /note="VH 1.53b"
QVQLVESGGGLVKPGGSLRLSCAASGFTFSDNSMTWMRQAPGKGLEWVSYISSGGSVKFYADSVKGRFTISRDNAKNSLYLQMNSLRADDTAVYYCAREAPLRLGESPHDAFDIWGQGTMVTVSS

SEQ ID NO: 728 - protein, 5 aa, Homo sapiens
  source: /note="CDR1 sequence of SEQ ID NO: 731"
DDSMT

SEQ ID NO: 729 - protein, 17 aa, Homo sapiens
  source: /note="CDR2 sequence of SEQ ID NO: 731"
YISSGGGVIFYADSVKG

SEQ ID NO: 730 - protein, 16 aa, Homo sapiens
  source: /note="CDR3 sequence of SEQ ID NO: 731"
EAPLRLGESPHDAFDI

SEQ ID NO: 731 - protein, 125 aa, Homo sapiens
  source: /note="VH 1.54b"
QVQLVESGGGLVKPGGSLRLSCAASGFTFSDDSMTWMRQAPGKGLEWVSYISSGGGVIFYADSVKGRFTISRDNAKNSLYLQMNSLRADDTAVYYCAREAPLRLGESPHDAFDIWGQGTMVTVSS

SEQ ID NO: 732 - protein, 5 aa, Homo sapiens
  source: /note="CDR1 sequence of SEQ ID NO: 735"
DNSMT

SEQ ID NO: 733 - protein, 17 aa, Homo sapiens
  source: /note="CDR2 sequence of SEQ ID NO: 735"
YISSGGGVKFYADSVKG

SEQ ID NO: 734 - protein, 16 aa, Homo sapiens
  source: /note="CDR3 sequence of SEQ ID NO: 735"
EAPLRLGESPHDAFDI

SEQ ID NO: 735 - protein, 125 aa, Homo sapiens
  source: /note="VH 1.55b"
QVQLVESGGGLVKPGGSLRLSCAASGFTFSDNSMTWMRQAPGKGLEWVSYISSGGGVKFYADSVKGRFTISRDNAKNSLYLQMNSLRADDTAVYYCAREAPLRLGESPHDAFDISGQGTMVTVSS

SEQ ID NO: 736 - protein, 5 aa, Homo sapiens
  source: /note="CDR1 sequence of SEQ ID NO: 739"
DNSMT

SEQ ID NO: 737 - protein, 17 aa, Homo sapiens
  source: /note="CDR2 sequence of SEQ ID NO: 739"
YISSGGAVKFYADSVKG

SEQ ID NO: 738 - protein, 16 aa, Homo sapiens
  source: /note="CDR3 sequence of SEQ ID NO: 739"
EAPLRLGESPHDAFDI

SEQ ID NO: 739 - protein, 125 aa, Homo sapiens
  source: /note="VH 1.56b"
QVQLVESGGGLVKPGGSLRLSCAASGFTFSDNSMTWMRQAPGKGLEWVSYISSGGAVKFYADSVKGRFTISRDNAKNSLYLQMNSLRADDTAVYYCAREAPLRLGESPHDAFDILGQGTMVTVSS

SEQ ID NO: 740 - protein, 5 aa, Homo sapiens
  source: /note="CDR1 sequence of SEQ ID NO: 743"
DNSMT

SEQ ID NO: 741 - protein, 17 aa, Homo sapiens
  source: /note="CDR2 sequence of SEQ ID NO: 743"
YISSGGGVIFYADSVKG

SEQ ID NO: 742 - protein, 16 aa, Homo sapiens
  source: /note="CDR3 sequence of SEQ ID NO: 743"
EAPLRLGESPHDAFDI

SEQ ID NO: 743 - protein, 125 aa, Homo sapiens
  source: /note="VH 1.57b"
QVQLVESGGGLVKPGGSLRLSCAASGFTFSDNSMTWMRQAPGKGLEWVSYISSGGGVIFYADSVKGRFTISRDNAKNSLYLQMNSLRADDTAVYYCAREAPLRLGESPHDAFDISGQGTMVTVSS

SEQ ID NO: 744 - protein, 5 aa, Homo sapiens
  source: /note="CDR1 sequence of SEQ ID NO: 747"
DNTMT

SEQ ID NO: 745 - protein, 17 aa, Homo sapiens
  source: /note="CDR2 sequence of SEQ ID NO: 747"
YISTGGGVKFYADSVKG

SEQ ID NO: 746 - protein, 16 aa, Homo sapiens
  source: /note="CDR3 sequence of SEQ ID NO: 747"
EAPLRLGESPHDAFDI

SEQ ID NO: 747 - protein, 125 aa, Homo sapiens; identical to SEQ ID NO: 519
  source: /note="VH 1.58b"

SEQ ID NO: 748 - protein, 5 aa, Homo sapiens
  source: /note="CDR1 sequence of SEQ ID NO: 751"
DNSMS

SEQ ID NO: 749 - protein, 17 aa, Homo sapiens
  source: /note="CDR2 sequence of SEQ ID NO: 751"
YISSGGSVKFYADSVKG

SEQ ID NO: 750 - protein, 16 aa, Homo sapiens
  source: /note="CDR3 sequence of SEQ ID NO: 751"
EAPLRLGESPHDAFDI

SEQ ID NO: 751 - protein, 125 aa, Homo sapiens
  source: /note="VH 1.59b"
QVQLVESGGGLVKPGGSLRLSCAASGFTFSDNTMTWMRQAPGKGLEWVSYISTGGGVKFYADSVKGRFTISRDNAKNSLYLQMNSLRADDTAVYYCAREAPLRLGESPHDAFDIWGQGTMVTVSS

SEQ ID NO: 752 - protein, 5 aa, Homo sapiens
  source: /note="CDR1 sequence of SEQ ID NO: 755"
DNSMT

SEQ ID NO: 753 - protein, 17 aa, Homo sapiens
  source: /note="CDR2 sequence of SEQ ID NO: 755"
YISTGGGVKYYADSVKG

SEQ ID NO: 754 - protein, 16 aa, Homo sapiens
  source: /note="CDR3 sequence of SEQ ID NO: 755"
EAPLRLGESPHDAFDI

SEQ ID NO: 755 - protein, 125 aa, Homo sapiens
  source: /note="VH 1.60b"
QVQLVESGGGLVKPGGSLRLSCAASGFTFSDNSMSWMRQAPGKGLEWVSYISSGGSVKFYADSVKGRFTISRDNAKNSLYLQMNSLRADDTAVYYCAREAPLRLGESPHDAFDIWGQGTMVTVSS

SEQ ID NO: 756 - protein, 5 aa, Homo sapiens
  source: /note="CDR1 sequence of SEQ ID NO: 759"
DYTMS

SEQ ID NO: 757 - protein, 17 aa, Homo sapiens
  source: /note="CDR2 sequence of SEQ ID NO: 759"
YISTGGGVKFYADSVKG

SEQ ID NO: 758 - protein, 16 aa, Homo sapiens
  source: /note="CDR3 sequence of SEQ ID NO: 759"
EAPLRLGESPHDAFDI

SEQ ID NO: 759 - protein, 125 aa, Homo sapiens
  source: /note="VH 1.61b"
QVQLVESGGGLVKPGGSLRLSCAASGFTFSDNSMTWMRQAPGKGLEWVSYISTGGGVKYYADSVKGRFTISRDNAKNSLYLQMNSLRADDTAVYYCAREAPLRLGESPHDAFDIWGQGTMVTVSS

SEQ ID NO: 760 - protein, 5 aa, Homo sapiens
  source: /note="CDR1 sequence of SEQ ID NO: 763"
DSSMT

SEQ ID NO: 761 - protein, 17 aa, Homo sapiens
  source: /note="CDR2 sequence of SEQ ID NO: 763"
YISSGGAVKFYTDSVKG

SEQ ID NO: 762 - protein, 16 aa, Homo sapiens
  source: /note="CDR3 sequence of SEQ ID NO: 763"
EAPLRLGESPHDAFDI

SEQ ID NO: 763 - protein, 125 aa, Homo sapiens
  source: /note="VH 1.62b"
QVQLVESGGGLVKPGGSLRLSCAASGFTFSDSSMTWMRQAPGKGLEWVSYISSGGAVKFYTDSVKGRFTISRDNAKNSLYLQMNSLRADDTAVYYCAREAPLRLGESPHDAFDISGQGTMVTVSS

SEQ ID NO: 764 - protein, 5 aa, Homo sapiens
  source: /note="CDR1 sequence of SEQ ID NO: 767"
DSSMT

SEQ ID NO: 765 - protein, 17 aa, Homo sapiens
  source: /note="CDR2 sequence of SEQ ID NO: 767"
YISSGGGVKFYTDSVKG

SEQ ID NO: 766 - protein, 16 aa, Homo sapiens
  source: /note="CDR3 sequence of SEQ ID NO: 767"
EAPLRLGESPHDAFDI

SEQ ID NO: 767 - protein, 125 aa, Homo sapiens
  source: /note="VH 1.63b"
EVQLVESGGGLVKPGGSLRLSCAASGFTFSDSSMTWMRQAPGKGLEWVSYISSGGGVKFYTDSVKGRFTISRDNAKNSLYLQMNSLRADDTAVYYCAREAPLRLGESPHDAFDISGQGTMVTVSS

SEQ ID NO: 768 - protein, 5 aa, Homo sapiens
  source: /note="CDR1 sequence of SEQ ID NO: 771"
DSSMT

SEQ ID NO: 769 - protein, 17 aa, Homo sapiens
  source: /note="CDR2 sequence of SEQ ID NO: 771"
YISSGGGVKFYADSVKG

SEQ ID NO: 770 - protein, 16 aa, Homo sapiens
  source: /note="CDR3 sequence of SEQ ID NO: 771"
EAPLRLGESPHDAFDI

SEQ ID NO: 771 - protein, 125 aa, Homo sapiens
  source: /note="VH 1.64b"
EVQLVESGGGLVKPGGSLRLSCAASGFTFSDSSMTWMRQAPGKGLEWVSYISSGGGVKFYADSVKGRFTISRDNAKNSLYLQMNSLRADDTAVYYCAREAPLRLGESPHDAFDISGQGTMVTVSS

SEQ ID NO: 772 - protein, 5 aa, Homo sapiens
  source: /note="CDR1 sequence of SEQ ID NO: 775"
DSSMT

SEQ ID NO: 773 - protein, 17 aa, Homo sapiens
  source: /note="CDR2 sequence of SEQ ID NO: 775"
YISSGGGVKFYADSVKG

SEQ ID NO: 774 - protein, 16 aa, Homo sapiens
  source: /note="CDR3 sequence of SEQ ID NO: 775"
EAPLRLGESPHDAFDI

SEQ ID NO: 775 - protein, 125 aa, Homo sapiens
  source: /note="VH 1.65b"
QVQLVESGGGLVKPGGSLRLSCAASGFTFSDSSMTWMRQAPGKGLEWVSYISSGGGVKFYADSVKGRFTISRDNAKNSLYLQMNSLRADDTAVYYCAREAPLRLGESPHDAFDISGQGTMVTVSS

SEQ ID NO: 776 - protein, 5 aa, Homo sapiens
  source: /note="CDR1 sequence of SEQ ID NO: 779"
DSSMT

SEQ ID NO: 777 - protein, 17 aa, Homo sapiens
  source: /note="CDR2 sequence of SEQ ID NO: 779"
YISSGGGVKFYTDSVKG

SEQ ID NO: 778 - protein, 16 aa, Homo sapiens
  source: /note="CDR3 sequence of SEQ ID NO: 779"
EAPLRLGESPHDAFDT

SEQ ID NO: 779 - protein, 125 aa, Homo sapiens
  source: /note="VH 1.66b"
QVQLVESGGGLVKPGGSLRLSCAASGFTFSDSSMTWMRQAPGKGLEWVSYISSGGGVKFYTDSVKGRFTISRDNAKNSLYLQMDSLRADDTAVYYCAREAPLRLGESPHDAFDTSGQGTMVTVSS

SEQ ID NO: 780 - protein, 5 aa, Homo sapiens
  source: /note="CDR1 sequence of SEQ ID NO: 783"
GSSMT

SEQ ID NO: 781 - protein, 17 aa, Homo sapiens
  source: /note="CDR2 sequence of SEQ ID NO: 783"
YISSGGGVIFYADSVKG

SEQ ID NO: 782 - protein, 16 aa, Homo sapiens
  source: /note="CDR3 sequence of SEQ ID NO: 783"
EAPLRLGESPHDAFDI

SEQ ID NO: 783 - protein, 125 aa, Homo sapiens
  source: /note="VH 1.67b"
QVQLVESGGGLVKPGGSLRLSCAASGFTFSGSSMTWMRQAPGKGLEWVSYISSGGGVIFYADSVKGRFTISRDNAKNSLYLQMNSLRADDTAVYYCAREAPLRLGESPHDAFDISGQGTMVTVSS

SEQ ID NO: 784 - protein, 5 aa, Homo sapiens
  source: /note="CDR1 sequence of SEQ ID NO: 787"
DNSMT

SEQ ID NO: 785 - protein, 17 aa, Homo sapiens
  source: /note="CDR2 sequence of SEQ ID NO: 787"
YISSGGGVIFYADSVKG

SEQ ID NO: 786 - protein, 16 aa, Homo sapiens
  source: /note="CDR3 sequence of SEQ ID NO: 787"
EAPLRLGESPHDAFDI

SEQ ID NO: 787 - protein, 125 aa, Homo sapiens
  source: /note="VH 1.68b"
QVQLVESGGGLVKPGGSLRLSCAASGFTFGDNSMTWMRQAPGKGLEWVSYISSGGGVIFYADSVKGRFTISRDNAKNSLYLQMNSLRADDTAVYYCAREAPLRLGESPHDAFDISGRGTTVTVSS

SEQ ID NO: 788 - protein, 5 aa, Homo sapiens
  source: /note="CDR1 sequence of SEQ ID NO: 791"
DNSMS

SEQ ID NO: 789 - protein, 17 aa, Homo sapiens
  source: /note="CDR2 sequence of SEQ ID NO: 791"
YISSGGGVIFYADSVKG

SEQ ID NO: 790 - protein, 16 aa, Homo sapiens
  source: /note="CDR3 sequence of SEQ ID NO: 791"
EAPLRLGESPHDAFDI

SEQ ID NO: 791 - protein, 125 aa, Homo sapiens
  source: /note="VH 1.69b"
QVQLVESGGGLVKPGGSLRLSCAASGFTFSDNSMSWMRQAPGKGLEWVSYISSGGGVIFYADSVKGRFTISRDNAKNSLYLQMNSLRADDTAVYYCAREAPLRLGESPHDAFDISGQGTMVTVSS

SEQ ID NO: 792 - protein, 5 aa, Homo sapiens
  source: /note="CDR1 sequence of SEQ ID NO: 795"
DSSMT

SEQ ID NO: 793 - protein, 17 aa, Homo sapiens
  source: /note="CDR2 sequence of SEQ ID NO: 795"
YISSGGAVKFYTDSVKG

SEQ ID NO: 794 - protein, 16 aa, Homo sapiens
  source: /note="CDR3 sequence of SEQ ID NO: 795"
EAPLRLGESPHDAFDI

SEQ ID NO: 795 - protein, 125 aa, Homo sapiens
  source: /note="VH 1.70b"
QVQLVESGGGLVKPGGSLRLSCAASGFTFGDSSMTWMRQAPGKGLEWVSYISSGGAVKFYTDSVKGRFTISRDNAKNSLYLQMNSLRADDTAVYYCAREAPLRLGESPHDAFDISGQGTMVTVSS

SEQ ID NO: 796 - protein, 5 aa, Homo sapiens
  source: /note="CDR1 sequence of SEQ ID NO: 799"
GSSMT

SEQ ID NO: 797 - protein, 17 aa, Homo sapiens
  source: /note="CDR2 sequence of SEQ ID NO: 799"
YISSGGGVKFYTDSVKG

SEQ ID NO: 798 - protein, 16 aa, Homo sapiens
  source: /note="CDR3 sequence of SEQ ID NO: 799"
EAPLRLGESPHDAFDI

SEQ ID NO: 799 - protein, 125 aa, Homo sapiens
  source: /note="VH 1.71b"
QVQLVESGGGLVKPGGSLRLSCAASGFTFGGSSMTWMRQAPGKGLEWVSYISSGGGVKFYTDSVKGRFTISRDNAKNSLYLQMNSLRADDTAVYYCAREAPLRLGESPHDAFDISGQGTMVTVSS

SEQ ID NO: 800 - protein, 5 aa, Homo sapiens
  source: /note="CDR1 sequence of SEQ ID NO: 803"
DSSMS

SEQ ID NO: 801 - protein, 17 aa, Homo sapiens
  source: /note="CDR2 sequence of SEQ ID NO: 803"
YISSGGGVIFYADSVKG

SEQ ID NO: 802 - protein, 16 aa, Homo sapiens
  source: /note="CDR3 sequence of SEQ ID NO: 803"
EAPLRLGESPHDAFDI

SEQ ID NO: 803 - protein, 125 aa, Homo sapiens
  source: /note="VH 1.72b"
QVQLVESGGGLVKPGGSLRLSCAASGFTFSDSSMSWMRQAPGKGLEWVSYISSGGGVIFYADSVKGRFTISRDNAKNSLYLQMNSLRADDTAVYYCAREAPLRLGESPHDAFDISGQGTMVTVSS

SEQ ID NO: 804 - protein, 5 aa, Homo sapiens
  source: /note="CDR1 sequence of SEQ ID NO: 807"
DSSMT

SEQ ID NO: 805 - protein, 17 aa, Homo sapiens
  source: /note="CDR2 sequence of SEQ ID NO: 807"
YISAGGGVRFYTDSVKG

SEQ ID NO: 806 - protein, 16 aa, Homo sapiens
  source: /note="CDR3 sequence of SEQ ID NO: 807"
EAPLRLGESPHDAFDI

SEQ ID NO: 807 - protein, 125 aa, Homo sapiens
  source: /note="VH 1.73b"
QVQLVESGGGLVKPGGSLRLSCAATGFTFSDSSMTWMRQAPGKGLEWVSYISAGGGVRFYTDSVKGRFTISRDNAKNSLYLQMNSLRADDTAVYYCAREAPLRLGESPHDAFDISGQGTMVTVSS

SEQ ID NO: 808 - DNA, 375 bp, Homo sapiens
  source: /note="VH 1.1b"
caggtgcagctggtggagtctgggggaggcttggtcaagcctggagggtccctgagactctcctgtgcagcctctggattcaccttcagtgactacaccatgacctggatgcggcaggctccagggaaggggctggagtgggtttcctacataagtactggtggtactatcaaatattacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 809 - DNA, 375 bp, Homo sapiens
  source: /note="VH 1.2b"
gaggtgcagctgttggagtctgggggaggcttggtcaagcctggagggtccctgagactctcctgtgcagcctctggattcaccttcagtgactacaccatgacctggatgcgccaggctccagggaaggggctggagtgggtttcatatataagtactggtggtagtatcaaatattacacagactctgtgaagggccgattcaccatctccagggacaacgccaagaactcactgtatctgcaaatgaacagcctgagagccgacgacacggccgtgtattactgtgcgagagaggcccctttacgtttgggggagtccccccatgatgcttttgatatctggggccaagggacaatggtcactgtctcctca

SEQ ID NO: 810 - DNA, 375 bp, Homo sapiens
  source: /note="VH 1.3b"
caggtgcagctggtggagtctgggggaggcttggtcaagcctggagggtccctgagactctcctgtgcagcctctggattcaccttcagtgactacaccatgacctggatgcgccaggctccagggaaggggctggagtgggtttcttacataagtactggtggtagtatcaaatattatacagactctgtgaagggccgattcaccatctccagggacaacgccaagaactcactgtatctgcaaatgaacagcctgagagccgacgacacggccgtgtattactgtgcgagagaggcccctttacgtttgggggagtccccccatgatgcttttgatatctggggccaagggacaatggtcactgtctcctca

SEQ ID NO: 811 - DNA, 375 bp, Homo sapiens
  source: /note="VH 1.4b"
caagtgcagctggtggagtctgggggaggcttggtcaagcctggagggtccctgagactctcctgtgcagcctctggattcaccttcagtgactactacatgatctggatgcgccaggctccagggaaggggctggagtgggtttcctacattagtggtggtggtactaccaaatattacacagactctgtgaagggccgattcaccatctccagggacaacgccaagaactcactgtatctgcaaatgaacagcctgagagccgacgacacggccgtgtactactgtgcgagagaggcccctttacgtttgggggagaccccccatgatgcttttgatatctggggccaagggacaatggtcactgtctcctca

SEQ ID NO: 812 - DNA, 375 bp, Homo sapiens
  source: /note="VH 1.5b"
gaagtgcagctggtggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggtaataccaaatattacacagactctgtgaagggccgcttcaccatctccagggacaacgccaagaactcactgtatctgcaaatgaacagcctgagagccgacgacacggccgtatattactgtgcgagagaggcccctttacgtttgggggagtccccccatgatgcttttgatatctggggccaagggacaatggtcactgtctcttca

SEQ ID NO: 813 - DNA, 375 bp, Homo sapiens
  source: /note="VH 1.6b"
gaggtgcagctgttggagtctgggggaggcttggtcaagcctggagggtccctgagactctcctgtgcagcctctggattcaccttcagtgactacaccatgacctggatgcggcaggctccagggaaggggctggagtgggtttcctacataagtactggtggtactatcaaatattacacagactctgtgaagggccgattcaccatctccagggacaacgccaagaactcactgtatctgcaaatgagcagcctgagagccgacgacacggccgtgtattactgtgcgcgagaggcccctttacgtttgggggagtccccccatgatgcttttgatatctggggccaagggacaatggtcactgtctcctca

SEQ ID NO: 814 - DNA, 375 bp, Homo sapiens
  source: /note="VH 1.7b"
gaagtgcagctggtggagtctgggggaggcttggtcaagcctggagggtccctgagactctcctgtgcagcctctggattcaccttcagtgactacaccatgacctggatgcgccaggctccagggaaggggctggagtgggtttcctacataagtactggtggtactatcaaatattacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcactgtctcttca

SEQ ID NO: 815 - DNA, 375 bp, Homo sapiens
  source: /note="VH 1.8b"
gaggtgcagctggtggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggtagtattaaatattacacagactctgtgaagggccgattcaccatctccagggacaacgccaagaactcactgtatctgcaaatgaacagcctgagagccggcgacacggccgtgtattactgtgcgagagaggcccctttacgtttgggggagtccccccatgatgcttttgatatctggggccaagggacaatggtcaccgtctcttca

SEQ ID NO: 816 - DNA, 375 bp, Homo sapiens
  source: /note="VH 1.9b"
caggtgcagctggtggagtctgggggaggcttggtcaagcctggagggtccctgagactctcctgtgcagcctctggattcaccttcggtgactacaccatgacctggatgcggcaggctccagggaaggggctggagtgggtttcctacataagtactggtggtactatcaaatattacacagactctgtgaagggccgattcaccatctccagggacaacgccaagaactcactgtatctgcaaatggacagcctgagagccgacgacacggccgtgtattactgtgcgcgagaggcccctttacgtttgggggagtccccccatgatgcttttgatatctggggccaagggacaatggtcactgtctcttca

SEQ ID NO: 817 - DNA, 375 bp, Homo sapiens
  source: /note="VH 1.10b"
caggtgcagctggtggagtctgggggaggcttggtcaagcctggagggtccctgagactctcctgtgcagcctctggattcaccttcagtgactacaccatgagctggatgcgccaggctccagggaaggggctggagtggatttcatacataagtcttggtggtaataccaaatattacacagactctgtgaagggccgattcaccatctccagggacaacgccaagaactcactgtatctgcaaatgaacagcctgcgagccgacgacacggccgtgtattactgtgcgagagaggcccctttacgtttgggggagtccccccatgatgcttttgatatctggggccaagggacaatggtcaccgtctcctca

SEQ ID NO: 818 - DNA, 375 bp, Homo sapiens
  source: /note="VH 1.11b"
gaggtgcagctgttggagtctgggggaggcttggtcaagcctggagggtccctgagactctcctgtgcagcctctggattcaccttcagtgactatgacatgacctggatccgccaggctccagggaaggggcaggagtgggtttcatatattagtcgtggtggtagtaccaaatactacgcagactctgtgaagggccgattcaccatctccagggacaacgccaagaactcactgtatctgcaaatgaacagcctgagagccgaggacacggccgtatactactgtgcgagagaggcccctttacgtttgggggagaccccccacgatgcttttgatatctggggccaagggacaatggtcaccgtctcttca

SEQ ID NO: 819 - DNA, 375 bp, Homo sapiens
  source: /note="VH 1.12b"
gaggtgcagctgttggagtctgggggaggcgtggtcaagcctggagggtccctgagactctcctgtgcagcctctggattcaccttcagtgactactatatgggctggatccgccaggctccagggaaggggctggagtggatttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaggcccctttgcgtttgggggagtccccccatgatgcttttgatatctggggccaagggacaatggtcactgtctcttca

SEQ ID NO: 820 - DNA, 375 bp, Homo sapiens
  source: /note="VH 1.13b"
gaggtgcagctgttggagtctgggggaggcttggtcaagcctggagggtccctgagactctcctgtgcagcctctggattcaccttcagtgactacaccatgacctggatgcggcaggctccagggaaggggctggagtgggtttcctacataagtactggtggtactatcaaatattacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcactgtctcttca

SEQ ID NO: 821 - DNA, 375 bp, Homo sapiens
  source: /note="VH 1.14b"
gaggtgcagctggtggagtctgggggaggcttggtacagcctggcaggtccctgagactctcctgtgcagcctctggattcaccttcagtgactacaccatgacctggatgcggcaggctccagggaaggggctggagtgggtttcctacataagtactggtggtactatcaaatattacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 822 - DNA, 375 bp, Homo sapiens
  source: /note="VH 1.15b"
caggtgcagctggtggagtctgggggaggcttggtcaagcctggagggtccctgagactctcctgtgcagcctctggattcaccttcagtgacaattccatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacaccctgagagccgaggacacggccgtgtattactgtgcgaaagaggcccctttacgtttgggggagtccccccatgatgcttttgatatctggggccaagggacaatggtcaccgtctcttca

SEQ ID NO: 823 - DNA, 375 bp, Homo sapiens
  source: /note="VH 1.16b"
gaagtgcagctggtggagtctgggggaggcttggtcaagcctggagggtccctgagactctcctgtgcagcctctggattcaccttcagtgactacaccatgagctggatgcgccaggctccagggaaggggctggagtgggtttcatacataagtactggtggtagtatcaaatattacacagactctgtgaagggccgattcaccatctccagggacaacgccaagaactcactgtatctgcaaatgaacagcctgagagccgacgacacggccgtgtattactgtgcgagagaggcccctttacgtttgggggagtccccccatgatgcttttgatatctggggccaagggacaatggtcaccgtctcctca

SEQ ID NO: 824 - DNA, 375 bp, Homo sapiens
  source: /note="VH 1.17b"
gaggtgcagctggtggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggcagtatcaaatattacacagactctgtgaagggccgattcaccatctccagggacaacgccaagaactcactgtatctgcaaatgaacagcctgagagtcgacgacacggccgtgtattactgtgcgagagaggcccctttacgtttgggggagtccccccatgatgcttttgatatctggggccaagggacaatggtcaccgtctcctca

SEQ ID NO: 825 - DNA, 375 bp, Homo sapiens
  source: /note="VH 1.18b"
caggtgcagctgttggagtctgggggaggcttggtcaagcctggagggtccctgagactctcctgtgcagcctctggattcaccttcagtgactacaccatgacctggatgcggcaggctccagggaaggggctggagtgggtttcctacataagtactggtggtactatcaaatattacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcactgtctcttca

SEQ ID NO: 826 - DNA, 375 bp, Homo sapiens
  source: /note="VH 1.19b"
caggtgcagctggtggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggtagtatcaaatattacacagactctgtgaagggccgattcaccatctccagggacaacgccaagaactcactgtatctgcaaatgaacagcctgagagccgaggacacggccgtatactactgtgcgagagaggcccctttacgtttgggggagaccccccacgatgcttttgatatctggggccaagggacaatggtcaccgtctcttca

SEQ ID NO: 827 - DNA, 375 bp, Homo sapiens
  source: /note="VH 1.20b"
gaggtgcagctgttggagtctgggggaggcttggtcaagcctggagggtccctgagactctcctgtgcagcctctggattcaccttcagtgactacaccatgacctggatgcgccaggctccagggaaggggctggagtgggtttcatacattagtagtggtggtagtatcaaattctacgcagactctgtgaagggccgattcaccatctccagggacaacgccaaaaactcactgtatctgcaaatgaacagcctgagagccgaggacacggccgtgtattactgtgcgagagaggcccctttacgtttgggggagtccccccatgatgcttttgatatctggggccaagggacaatggtcaccgtctcctca

SEQ ID NO: 828 - DNA, 375 bp, Homo sapiens
  source: /note="VH 1.21b"
gaggtgcagctggtggagtctgggggaggcttggtcaagcctggagggtccctgagactctcctgtgcagcctctggattcaccttcagtgactacaccatgacctggatgcgccaggctccagggaaggggctggagtgggtttcatatataagtactggtggtagtatcaaatattacacagactctgtgaagggccgattcaccatctccagggacaacgccaagaactcactgtatctgcaaatgaacagcctgagagccgacgacacggccgtgtattactgtgcgagagaggcccctttacgtttgggggagtccccccatgatgcttttgatacctggggccaagggacaatggtcaccgtctcttca

SEQ ID NO: 829 - DNA, 375 bp, Homo sapiens
  source: /note="VH 1.22b"
gaagtgcagctggtggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggtagtatcaaatattacacagactctgtgaagggccgattcaccatctccagggacaacgccaagaactcattgtatctgcaaatgaacagcctgagagccgacgacacggccgtgtattactgtgcgagagaggcccctttacgtttgggggagtccccccatgatgcttttgatatctggggccaagggacaatggtcactgtctcttca

SEQ ID NO: 830 - DNA, 375 bp, Homo sapiens
  source: /note="VH 1.23b"
cagatcaccttgaaggagtctgggggaggcttggtcaagcctggagggtccctgagactctcctgtgcagcctctggattcaccttcagtgactacaccatgagctggatgcggcaggctccagggaaggggctggagtgggtttcctacataagtactggtggtactatcaaatattacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 831 - DNA, 375 bp, Homo sapiens
  source: /note="VH 1.24b"
caggtcaccttgaaggagtctgggggaggcttggtcaagcctggagggtccctgagactctcctgtgcagcctctggattcaccttcagtgactatgacatgtactggatccgccaggctccagggaaggggctggagtgggtttcatatattagtcgtggtggtagtgtaacatactacgcagactctgtgaagggccgattcaccatttccagggacaacgccaagaacgcactgtatctgcaaatgaacagcctgagagccgaggacatggccgtatatttttgtgcgacagaggcccctttacgtttgggggagaccccccatgctgcttttgatatctggggccaagggacaatggtcaccgtctcctca

SEQ ID NO: 832 - DNA, 375 bp, Homo sapiens
  source: /note="VH 1.25b"
caggtcaccttgaaggagtctgggggaggcttggtcaagcctggagggtccctgagactctcctgtgcagcctctggattcaccttcagtgactactacatgagctggttccgccaggctccagggaaggaacgggagtggatttcatttattagtagtagtggtagtaccacatactacgcagactctgtgaagggccgattcaccatctccagggacaacgccaagaactcactgtatctgcaaatgaacagcctgagagccgaggatacggccgtctattactgtgcgagagaggcccctttacgtttgggggagtccccccatgatgcttttgatttctggggccaagggacaatggtcaccgtctcttca

SEQ ID NO: 833 - DNA, 375 bp, Homo sapiens
  source: /note="VH 1.26b"
caggtcaccttgaaggagtctgggggaggcttggtcaagcctggagggtccctgagactctcctgtgcagcctctggattcaccttcagtgacaattccatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacaccctgagagccgaggacacggccgtgtattactgtgcgaaagaggcccctttacgtttgggggagtccccccatgatgcttttgatatctggggccaagggacaatggtcaccgtctcctca

SEQ ID NO: 834 - DNA, 375 bp, Homo sapiens
  source: /note="VH 1.27b"
caggtcaccttgaaggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggtagtatcaaatattacacagactctgtgaagggccgattcaccatctccagggacaacgccaagaactcactgtatctgcaaatgaacagcctgagagccgacgacacggccgtgtattactgtgcgagagaggcccctttacgtttgggggagtccccccatgatgcttttgatatctggggccaagggacaatggtcaccgtctcttca

SEQ ID NO: 835 - DNA, 375 bp, Homo sapiens
  source: /note="VH 1.28b"
cagatcaccttgaaggagtctgggggaggcttggtcaagcctggagggtccctgagactctcctgtgcagcctctggattcaccttcagtgactatgacatgtactggatccgccaggctccagggaaggggctggagtgggtttcatatattagtcgtggtggtagtgtaacatactacgcagactctgtgaagggccgattcaccatttccagggacaacgccaagaacgcactgtatctgcaaatgaacagcctgagagccgaggacatggccgtatatttttgtgcgacagaggcccctttacgtttgggggagaccccccatgctgcttttgatatctggggccaagggacaatggtcaccgtctcttca

SEQ ID NO: 836 - DNA, 375 bp, Homo sapiens
  source: /note="VH 1.29b"
caggtcaccttgaaggagtctgggggaggcttggtcaagcctggagggtccctgagactctcctgtgcagcctctggattcaccttcagtgactacaccatgagctggatgcggcaggctccagggaaggggctggagtgggtttcctacataagtactggtggtactatcaaatattacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcttca

SEQ ID NO: 837 - DNA, 375 bp, Homo sapiens
  source: /note="VH 1.30b"
caggtcaccttgaaggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggtagtatcaaatattacacagactctgtgaagggccgattcaccatctccagggacaacgccaggaactcactatatctgcagatgaacagcctgagagccgaggacacggccgtgtattactgtgcgagagaggcccctttacgtttgggggagtccccccatgatgcttttgatatctggggccaagggacaatggtcaccgtctcttca

SEQ ID NO: 838 - DNA, 375 bp, Homo sapiens
  source: /note="VH 1.31b"
caggtcaccttgaaggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggtagtaccaaatattacacagactctgtgaagggccgattcaccatctccagggacaacgccaagaactcactgtatctgcaaatgaacagcctgagagccgacgacacggccgtgtattactgtgcgagagaggcccctttacgtttgggggagtccccccatgatgcttttgatatctggggccaagggacaatggtcactgtctcctca

SEQ ID NO: 839 - DNA, 375 bp, Homo sapiens
  source: /note="VH 1.32b"
caggtcaccttgaaggagtctgggggaggcttggtcaagccgggagggtccctgagactctcctgtgcagcctctggattcaccttcagtgacgactacatgatgtggatccgccaggctccagggaaggggctggagtgggtttcatacattagtagtggtggtagtattatatactacgcagactctgtgaagggccgattcaccatttccagggacaacgccaagaactcactgtatctgcaaatgaacagcctgagagccgaggacacggccgtgtattactgtgcgagagaggcccctttacgtttgggggagtccccccatgatgcttttgatatcaggggccaagggacaatggtcactgtctcctca

SEQ ID NO: 840 - DNA, 375 bp, Homo sapiens
  source: /note="VH 1.33b"
caggtcaccttgaaggagtctgggggaggcttggtcaagcctggagggtccctgagactctcctgtgcagcctctggattcaccttcagtgactatgacatgtactgggtccgccaggctccagggaaggggctggagtgggtttcatatattagtcgtggtggtagtgtaacatactacgcagactctgtgaagggccgattcaccatttccagggacaacgccaagaacgcactgtatctgcaaatgaacagcctgagagccgaggacatggccgtatatttttgcgcgacagaggcccctttacgtttgggggagaccccccatgctgcttttgatatctggggccaagggacaatggtcaccgtctcctca

SEQ ID NO: 841 - DNA, 375 bp, Homo sapiens
  source: /note="VH 1.34b"
gaggtgcagctggtggagtctgggggaggcttggtcaagcctggagggtccctgagactctcctgtgcagcctctggattcaccttcagtgactacaccatgacctggatgcgccaggctccagggaaggggctggagtgggtttcatacataagtactggtggtagtgttaaatattacacagactctgtgaagggccgattcaccatctccagggacaacgccaagaactcactgtatctgcaaatgaacagcctgagagccgacgacacggccgtgtattactgtgcgagagaggcccctttacgtttgggggagtccccccatgatgcttttgatatctggggccaagggacaatggtcactgtctcctca

SEQ ID NO: 842 - DNA, 375 bp, Homo sapiens
  source: /note="VH 1.35b"
gaggtgcagctgttggagtctgggggaggcttggtcaagcctggagggtccctgagactctcctgtgcagcctctggattcaccttcagtgactacaccatgacctggatgcgccaggctccagggaaggggctggagtgggtttcttacataagtactggtggtagtatcaaatattacacagactctgtgaagggccgattcaccatctccagggacaacgccaagaactcactgtatctgcaaatgaacagcctgagagtcgacgacacggccgtgtattactgtgcgagagaggcccctttacgtttgggggagtccccccatgatgcttttgatatctggggccaagggacaatggtcaccgtctcctca

SEQ ID NO: 843 - DNA, 375 bp, Homo sapiens
  source: /note="VH 1.36b"
gaagtgcagctggtggagtctgggggaggcttggtcaagcctggagggtccctgagactctcctgtgcagcctctggattcaccttcagtgactacaccatgacctggatgcggcaggctccagggaaggggctggagtgggtttcctacataagtactggtggtactatcaaatattatacagactctgtgaagggccgattcaccatctccagggacaacgccaagaattcactgtttctgcaaatgaacagcctgagagccgacgacacggccgtttattactgtgcgagagaggcccctttacgtttgggggagtccccccatgatgcttttgatatctggggccaagggacaatggtcactgtctcttca

SEQ ID NO: 844 - DNA, 375 bp, Homo sapiens
  source: /note="VH 1.37b"
caggtgcagctggtggagtctgggggaggcttggtcaagcctggagggtccctgagactctcctgtgcagcctctggattcaccttcagtgactacaccatgacctggatgcgccaggctccagggaaggggctggagtgggtttcttacataagtactggtggtagtatcaaatattatacagactctgtgaagggccgattcaccatctccagggacaacgccaagaattcactgtttctgcaaatgaacagcctgagagccgacgacacggccgtgtattactgtgcgagagaggcccctttacgtttgggggagtccccccatgatgcttttgatatctggggccaagggacaatggtcaccgtctcctca

SEQ ID NO: 845 - DNA, 375 bp, Homo sapiens
  source: /note="VH 1.38b"
gaggtgcagctggtggagtctgggggaggcttggtccagcctggggggtccctgagactctcctgtgcagcctctggattcaccttcagtgactacaccatgacctggatgcggcaggctccagggaaggggctggagtgggtttcctacataagtactggtggtactatcaaatattacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 846 - DNA, 375 bp, Homo sapiens
  source: /note="VH 1.39b"
  modified_base (273)..(273): a, c, t, g, unknown or other
caggtgcagctgcaggagtcggggggaggcttggtcaagcctggagggtccctgagactctcctgtgcagcctctggattcaccttcagtgactacaccatgacctggatgcgccaggctccagggaaggggctggagtgggtttcatacataagtactggtggtagtatcaaatattacacagactctgtgaagggccgattcaccatctccagggacaacgccaagaactcactgtatctgcaaatgaacagcctgagagccgacgacacngccgtgtattactgtgcgagagaggcccctttacgtttgggggagtccccccatgatgcttttgatatctggggccaagggacaatggtcactgtctcttca

SEQ ID NO: 847 - DNA, 375 bp, Homo sapiens
  source: /note="VH 1.40b"
gaggtgcagctggtggagtctgggggaggcttggtcaagcctggagggtccctgagactctcctgtgcagcctctggattcaccttcagtgactcctccatgagctggatccgccaggctccagggagggggctggaatggatttcatacattagtagtggtggtggtatcatatactacacagactctgtgaagggccgattcaccatctccagggacaacgccaagaactcactgtatctacagatgaacagcctgagagtcgaggacacggccgtgtattactgtgcgaaagaggcccctttacgtttgggggagtccccccatgatgcttttgatatctggggccacgggacaatggtcaccgtctcttca

SEQ ID NO: 848 - DNA, 375 bp, Homo sapiens
  source: /note="VH 1.41b"
caggtgcagctggttgagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 849 - DNA, 375 bp, Homo sapiens
  source: /note="VH 1.42b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 850 - DNA, 375 bp, Homo sapiens; identical to SEQ ID NO: 849
  source: /note="VH 1.43b"

SEQ ID NO: 851 - DNA, 375 bp, Homo sapiens
  source: /note="VH 1.44b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtgctgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 852 - DNA, 375 bp, Homo sapiens
  source: /note="VH 1.45b"
caggtgcagctggtggagtctgggggaggcttggtcaagcctggagggtccctgagactctcctgtgcagcctctggattcaccttcagtgactactccatgtcctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 853 - DNA, 375 bp, Homo sapiens
  source: /note="VH 1.46b"
caggtgcagctggtggagtctgggggaggcttggtcaagcctggagggtccctgagactctcctgtgcagcctctggattcaccttcagtgacagctccatgtcctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 854 - DNA, 375 bp, Homo sapiens
  source: /note="VH 1.47b"
caggtgcagctggtggagtctgggggaggcttggtcaagcctggagggtccctgagactctcctgtgcagcctctggattcaccttcagtgacaactccatgtcctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 855 - DNA, 375 bp, Homo sapiens
  source: /note="VH 1.48b"
caggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 856 - DNA, 375 bp, Homo sapiens
  source: /note="VH 1.49b"
caggtgcaactggttgaaagcggcggcgggttagtaaaacccggaggctccctgcgactgagttgcgcggccagtgggttcacatttagcgattccagcatgtcatggatgcgtcaagctcccggtaaaggcttagagtgggtttcgtacattagcacaggtggtggtgtcaaattctatgctgattctgtcaaaggccgttttaccatctcccgggataatgcaaagaactcgttgtatttgcagatgaacagcttacgcgccgacgatactgcagtctattattgcgcacgcgaagctcctctgcgcttaggtgagagcccacatgacgcctttgatatatgggggcaaggaacaatggtgaccgtgtccagc

SEQ ID NO: 857 - DNA, 375 bp, Homo sapiens
  source: /note="VH 1.50b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtactatcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 858 - DNA, 375 bp, Homo sapiens
  source: /note="VH 1.51b"
caggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtgctgtcaaattttacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 859 - DNA, 375 bp, Homo sapiens
  source: /note="VH 1.52b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtggtgtcaaatattacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 860 - DNA, 375 bp, Homo sapiens
  source: /note="VH 1.53b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtagtgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 861 - DNA, 375 bp, Homo sapiens
  source: /note="VH 1.54b"
caggtgcagctggtggagtctgggggaggcttggtcaagcctggagggtccctgagactctcctgtgcagcctctggattcaccttcagtgacgactccatgacctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 862 - DNA, 375 bp, Homo sapiens
  source: /note="VH 1.55b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtcccctcatgatgcttttgatatctcgggccaagggacaatggtcaccgtctcctca

SEQ ID NO: 863 - DNA, 375 bp, Homo sapiens
  source: /note="VH 1.56b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtgctgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatcttgggccaagggacaatggtcaccgtctcctca

SEQ ID NO: 864 - DNA, 375 bp, Homo sapiens
  source: /note="VH 1.57b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaagggacaatggtcaccgtctcctca

SEQ ID NO: 865 - DNA, 375 bp, Homo sapiens
  source: /note="VH 1.58b"
caggtgcagctggtggagtctgggggaggcttggtcaagcctggagggtccctgagactctcctgtgcagcctctggattcaccttcagtgacaacaccatgacctggatgcggcaggctccagggaaggggctggagtgggtttcctacataagtactggtggtggtgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 866 - DNA, 375 bp, Homo sapiens
  source: /note="VH 1.59b"
caggtgcagctggtggagtctgggggaggcttggtcaagcctggagggtccctgagactctcctgtgcagcctctggattcaccttcagtgacaactccatgtcctggatgcggcaggctccagggaaggggctggagtgggtttcctacataagttctggtggtagtgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 867 - DNA, 375 bp, Homo sapiens
  source: /note="VH 1.60b"
caggtgcagctggtggagtctgggggaggcttggtcaagcctggagggtccctgagactctcctgtgcagcctctggattcaccttcagtgacaactccatgacctggatgcggcaggctccagggaaggggctggagtgggtttcctacataagtactggtggtggtgtcaaatattacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 868 - DNA, 375 bp, Homo sapiens
  source: /note="VH 1.61b"
caggtgcagctggtggagtctgggggaggcttggtcaagcctggagggtccctgagactctcctgtgcagcctctggattcaccttcagtgactacaccatgtcctggatgcggcaggctccagggaaggggctggagtgggtttcctacataagtactggtggtggtgtcaaattttacgcagactctgtgaagggccgattcaccatctccagggacaatgccaagaactcactgtatctgcaaatgaacagcctgagagccgacgacacggccgtgtattactgtgcgcgagaggcccctttacgtttgggggagtccccccatgatgcttttgatatctggggccaagggacaatggtcaccgtctcctca

SEQ ID NO: 869 - DNA, 375 bp, Homo sapiens
  source: /note="VH 1.62b"
caggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtgctgtcaaattttacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaagggacaatggtcaccgtctcctca

SEQ ID NO: 870 - DNA, 375 bp, Homo sapiens
  source: /note="VH 1.63b"
gaggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaagggacaatggtcaccgtctcctca

SEQ ID NO: 871 - DNA, 375 bp, Homo sapiens
  source: /note="VH 1.64b"
gaggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaagggacaatggtcaccgtctcctca

SEQ ID NO: 872 - DNA, 375 bp, Homo sapiens
  source: /note="VH 1.65b"
caggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaagggacaatggtcaccgtctcctca

SEQ ID NO: 873 - DNA, 375 bp, Homo sapiens
  source: /note="VH 1.66b"
caggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatggacagcctgagagccgacgacacggccgtgtattactgtgcgcgagaggcccctttacgtttgggggagtccccccatgatgcttttgatacctcgggccaagggacaatggtcaccgtctcctca

SEQ ID NO: 874 - DNA, 375 bp, Homo sapiens
  source: /note="VH 1.67b"
caggtgcagctggtggagtctgggggaggcttggtcaagcctggagggtccctgagactctcctgtgcagcctctggattcaccttcagtggcagctccatgacctggatgcggcaggctccagggaaggggctggagtgggtttcctacataagttctggtggcggtgtcatattttacgcagactctgtgaagggccgattcaccatctccagggacaacgccaagaactcactgtatctgcaaatgaacagcctgagggccgacgacacggccgtgtactactgtgcgcgagaggcccctttacgtttgggggagtccccccatgacgctttcgatatctcgggccaagggacaatggtcaccgtctcctca

SEQ ID NO: 875 - DNA, 375 bp, Homo sapiens
  source: /note="VH 1.68b"
caggtgcagctggtggagtctgggggaggcttggtcaagcctggagggtccctgagactctcctgtgcagcctctggattcaccttcggtgacaactccatgacctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccgagggacaacggtcaccgtctcctca

SEQ ID NO: 876 - DNA, 375 bp, Homo sapiens
  source: /note="VH 1.69b"
caggtgcagctggtggagtctgggggaggcttggtcaagcctggagggtccctgagactctcctgtgcagcctctggattcaccttcagtgacaactccatgtcctggatgcggcaggctccagggaaggggctggagtgggtttcctacataagttctggtggtggtgtcatattttacgcagactctgtgaagggccgattcaccatctccagggacaacgccaagaactcactgtatctgcaaatgaacagcctgagggccgacgacacggccgtgtattactgtgcgcgagaggcccctttacgtttgggggagtccccccatgatgcttttgatatctcgggccaagggacaatggtcaccgtctcttca

SEQ ID NO: 877 - DNA, 375 bp, Homo sapiens
  source: /note="VH 1.70b"
caggtgcagctggtggagtctgggggaggtttggtcaagcctggagggtccctgagactctcctgtgcagcctctggattcaccttcggtgacagctccatgacctggatgcggcaggctccagggaaggggctggagtgggtttcctacataagttctggtggtgctgtcaagttttacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaagggacaatggtcaccgtctcctca

SEQ ID NO: 878 - DNA, 375 bp, Homo sapiens
  source: /note="VH 1.71b"
caggtgcagctggtggagtctgggggaggcttggtcaagcctggagggtccctgaggctctcctgtgcagcctcaggattcaccttcggtggcagctccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaggggacaatggtcaccgtctcctca

SEQ ID NO: 879 - DNA, 375 bp, Homo sapiens
  source: /note="VH 1.72b"
caggtgcagctggtggagtctgggggaggcttggtcaagcctggagggtccctgagactctcctgtgcagcctctggattcaccttcagtgacagctccatgtcctggatgcggcaggctccagggaaggggctggagtgggtttcctacataagttctggtggtggtgtcatattttacgcagactctgtgaagggccgattcaccatctccagggacaacgccaagaactcgctgtatctgcaaatgaacagcctgagagccgacgacacggccgtgtattactgtgcgcgagaggcccctttacgtttgggggagtccccccatgatgcttttgatatctcgggccaagggacaatggtcaccgtctcttca

SEQ ID NO: 880 - DNA, 375 bp, Homo sapiens
  source: /note="VH 1.73b"
caggtgcagctggtggagtctgggggaggcttggtcaagcctggagggtccctgagactctcctgtgcagccactggattcaccttcagtgacagctccatgacctggatgcggcaggctccagggaaggggctggagtgggtttcctacataagtgctggtggtggtgtcagattttacacagactctgtgaagggccgattcaccatctccagggacaacgccaagaactcactgtatctgcaaatgaacagcctgagggccgacgacacggccgtgtattactgtgcgcgagaggcccctttacgtttgggggagtccccccatgatgcttttgatatctcgggccaagggacaatggtcaccgtctcatca

SEQ ID NO: 881 - protein, 5 aa, Homo sapiens
  source: /note="CDR1 sequence of SEQ ID NO: 884"
DSSMT

SEQ ID NO: 882 - protein, 17 aa, Homo sapiens
  source: /note="CDR2 sequence of SEQ ID NO: 884"
YISSGGGVKFYTDSVKG

SEQ ID NO: 883 - protein, 16 aa, Homo sapiens
  source: /note="CDR3 sequence of SEQ ID NO: 884"
EAPLRLGESPHDAFDI

SEQ ID NO: 884 - protein, 125 aa, Homo sapiens
  source: /note="VH 1.74b"
EVQLVESGGGLVKPGGSLRLSCAASGFTFSDSSMTWIRQAPGKGLEWVSYISSGGGVKFYTDSVKGRFTISRDNAKNSLYLQMNSLRADDTAVYYCAREAPLRLGESPHDAFDISGQGTMVTVSS

SEQ ID NO: 885 - protein, 5 aa, Homo sapiens
  source: /note="CDR1 sequence of SEQ ID NO: 888"
DSSMT

SEQ ID NO: 886 - protein, 17 aa, Homo sapiens
  source: /note="CDR2 sequence of SEQ ID NO: 888"
YISSGGGVKFYTDSVKG

SEQ ID NO: 887 - protein, 16 aa, Homo sapiens
  source: /note="CDR3 sequence of SEQ ID NO: 888"
EAPLRLGESPHDAFDI

SEQ ID NO: 888 - protein, 125 aa, Homo sapiens
  source: /note="VH 1.75b"
EVQLVESGGGLVKPGGSLRLSCAASGFTFSDSSMTWIRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 889 - protein, 5 aa, Homo sapiens
  source: /note="CDR1 sequence of SEQ ID NO: 892"
DSSMT

SEQ ID NO: 890 - protein, 17 aa, Homo sapiens
  source: /note="CDR2 sequence of SEQ ID NO: 892"
YISSGGGVKFYADSVKG

SEQ ID NO: 891 - protein, 16 aa, Homo sapiens
  source: /note="CDR3 sequence of SEQ ID NO: 892"
EAPLRLGESPHDAFDI

SEQ ID NO: 892 - protein, 125 aa, Homo sapiens
  source: /note="VH 1.76b"
EVQLVESGGGLVKPGGSLRLSCAASGFTFSDSSMTWIRQAPGKGLEWVSYISSGGGVKFYADSVKGRFTISRDNAKNSLYLQMNSLRADDTAVYYCAREAPLRLGESPHDAFDISGQGTMVTVSS

SEQ ID NO: 893 - protein, 5 aa, Homo sapiens
  source: /note="CDR1 sequence of SEQ ID NO: 896"
DSSMT

SEQ ID NO: 894 - protein, 17 aa, Homo sapiens
  source: /note="CDR2 sequence of SEQ ID NO: 896"
YISSGGGVKFYTDSVKG

SEQ ID NO: 895 - protein, 16 aa, Homo sapiens
  source: /note="CDR3 sequence of SEQ ID NO: 896"
EAPLRLGESPHDAFDI

SEQ ID NO: 896 - protein, 125 aa, Homo sapiens
  source: /note="VH 1.77b"
EVQLVESGGGLVKPGGSLRLSCAASGFTFSDSSMTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 897 - protein, 5 aa, Homo sapiens
  source: /note="CDR1 sequence of SEQ ID NO: 900"
DSSMT

SEQ ID NO: 898 - protein, 17 aa, Homo sapiens
  source: /note="CDR2 sequence of SEQ ID NO: 900"
YISSGGGVKFYADSVKG

SEQ ID NO: 899 - protein, 16 aa, Homo sapiens
  source: /note="CDR3 sequence of SEQ ID NO: 900"
EAPLRLGESPHDAFDI

SEQ ID NO: 900 - protein, 125 aa, Homo sapiens
  source: /note="VH 1.78b"
EVQLVESGGGLVKPGGSLRLSCAASGFTFSDSSMTWIRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 901 - protein, 5 aa, Homo sapiens
  source: /note="CDR1 sequence of SEQ ID NO: 904"
DSSMT

SEQ ID NO: 902 - protein, 17 aa, Homo sapiens
  source: /note="CDR2 sequence of SEQ ID NO: 904"
YISSGGGVKFYADSVKG

SEQ ID NO: 903 - protein, 16 aa, Homo sapiens
  source: /note="CDR3 sequence of SEQ ID NO: 904"
EAPLRLGESPHDAFDI

SEQ ID NO: 904 - protein, 125 aa, Homo sapiens
  source: /note="VH 1.79b"
EVQLVESGGGLVKPGGSLRLSCAASGFTFSDSSMTWKRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 905 - protein, 5 aa, Homo sapiens
  source: /note="CDR1 sequence of SEQ ID NO: 908"
DSSMT

SEQ ID NO: 906 - protein, 17 aa, Homo sapiens
  source: /note="CDR2 sequence of SEQ ID NO: 908"
YISSGGGVKFYADSVKG

SEQ ID NO: 907 - protein, 16 aa, Homo sapiens
  source: /note="CDR3 sequence of SEQ ID NO: 908"
EAPLRLGESPHDAFDI

SEQ ID NO: 908 - protein, 125 aa, Homo sapiens
  source: /note="VH 1.80b"
EVQLVESGGGLVKPGGSLRLSCAASGFTFSDSSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 909 - protein, 5 aa, Homo sapiens
  source: /note="CDR1 sequence of SEQ ID NO: 912"
DSSMT

SEQ ID NO: 910 - protein, 17 aa, Homo sapiens
  source: /note="CDR2 sequence of SEQ ID NO: 912"
YISSGGGVKFYADSVKG

SEQ ID NO: 911 - protein, 16 aa, Homo sapiens
  source: /note="CDR3 sequence of SEQ ID NO: 912"
EAPLRLGESPHDAFDI

SEQ ID NO: 912 - protein, 125 aa, Homo sapiens
  source: /note="VH 1.81b"
EVQLVESGGGLVKPGGSLRLSCAASGFTFSDSSMTWVRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 913 - protein, 5 aa, Homo sapiens
  source: /note="CDR1 sequence of SEQ ID NO: 916"
DTSMT

SEQ ID NO: 914 - protein, 17 aa, Homo sapiens
  source: /note="CDR2 sequence of SEQ ID NO: 916"
YISSGGGVKFYTDSVKG

SEQ ID NO: 915 - protein, 16 aa, Homo sapiens
  source: /note="CDR3 sequence of SEQ ID NO: 916"
EAPLRLGESPHDAFDI

SEQ ID NO: 916 - protein, 125 aa, Homo sapiens
  source: /note="VH 1.82b"
EVQLVESGGGLVKPGGSLRLSCAASGFTFSDTSMTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 917 - protein, 5 aa, Homo sapiens
  source: /note="CDR1 sequence of SEQ ID NO: 920"
DESMT

SEQ ID NO: 918 - protein, 17 aa, Homo sapiens
  source: /note="CDR2 sequence of SEQ ID NO: 920"
YISSGGGVKFYTDSVKG

SEQ ID NO: 919 - protein, 16 aa, Homo sapiens
  source: /note="CDR3 sequence of SEQ ID NO: 920"
EAPLRLGESPHDAFDI

SEQ ID NO: 920 - protein, 125 aa, Homo sapiens
  source: /note="VH 1.83b"
EVQLVESGGGLVKPGGSLRLSCAASGFTFSDESMTWFRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 921 - protein, 5 aa, Homo sapiens
  source: /note="CDR1 sequence of SEQ ID NO: 924"
DESMT

SEQ ID NO: 922 - protein, 17 aa, Homo sapiens
  source: /note="CDR2 sequence of SEQ ID NO: 924"
YISSGGGVKFYTDSVKG

SEQ ID NO: 923 - protein, 16 aa, Homo sapiens
  source: /note="CDR3 sequence of SEQ ID NO: 924"
EAPLRLGESPHDAFDI

SEQ ID NO: 924 - protein, 125 aa, Homo sapiens
  source: /note="VH 1.84b"
EVQLVESGGGLVKPGGSLRLSCAASGFTFSDESMTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 925 - protein, 5 aa, Homo sapiens
  source: /note="CDR1 sequence of SEQ ID NO: 928"
DYSMT

SEQ ID NO: 926 - protein, 17 aa, Homo sapiens
  source: /note="CDR2 sequence of SEQ ID NO: 928"
YISSGGGVKFYTDSVKG

SEQ ID NO: 927 - protein, 16 aa, Homo sapiens
  source: /note="CDR3 sequence of SEQ ID NO: 928"
EAPLRLGESPHDAFDI

SEQ ID NO: 928 - protein, 125 aa, Homo sapiens
  source: /note="VH 1.85b"
EVQLVESGGGLVKPGGSLRLSCAASGFTFSDYSMTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 929 - protein, 5 aa, Homo sapiens
  source: /note="CDR1 sequence of SEQ ID NO: 932"
DASMT

SEQ ID NO: 930 - protein, 17 aa, Homo sapiens
  source: /note="CDR2 sequence of SEQ ID NO: 932"
YISSGGGVKFYTDSVKG

SEQ ID NO: 931 - protein, 16 aa, Homo sapiens
  source: /note="CDR3 sequence of SEQ ID NO: 932"
EAPLRLGESPHDAFDI

SEQ ID NO: 932 - protein, 125 aa, Homo sapiens
  source: /note="VH 1.86b"
EVQLVESGGGLVKPGGSLRLSCAASGFTFSDASMTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 933 - protein, 5 aa, Homo sapiens
  source: /note="CDR1 sequence of SEQ ID NO: 936"
DKSMT

SEQ ID NO: 934 - protein, 17 aa, Homo sapiens
  source: /note="CDR2 sequence of SEQ ID NO: 936"
YISSGGGVKFYTDSVKG

SEQ ID NO: 935 - protein, 16 aa, Homo sapiens
  source: /note="CDR3 sequence of SEQ ID NO: 936"
EAPLRLGESPHDAFDI

SEQ ID NO: 936 - protein, 125 aa, Homo sapiens
  source: /note="VH 1.87b"
EVQLVESGGGLVKPGGSLRLSCAASGFTFSDKSMTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 937 - protein, 5 aa, Homo sapiens
  source: /note="CDR1 sequence of SEQ ID NO: 940"
DRSMT

SEQ ID NO: 938 - protein, 17 aa, Homo sapiens
  source: /note="CDR2 sequence of SEQ ID NO: 940"
YISSGGGVKFYTDSVKG

SEQ ID NO: 939 - protein, 16 aa, Homo sapiens
  source: /note="CDR3 sequence of SEQ ID NO: 940"
EAPLRLGESPHDAFDI

SEQ ID NO: 940 - protein, 125 aa, Homo sapiens
  source: /note="VH 1.88b"
EVQLVESGGGLVKPGGSLRLSCAASGFTFSDRSMTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 941 - protein, 5 aa, Homo sapiens
  source: /note="CDR1 sequence of SEQ ID NO: 944"
DYSMT

SEQ ID NO: 942 - protein, 17 aa, Homo sapiens
  source: /note="CDR2 sequence of SEQ ID NO: 944"
YISSGGGVKFYADSVKG

SEQ ID NO: 943 - protein, 16 aa, Homo sapiens
  source: /note="CDR3 sequence of SEQ ID NO: 944"
EAPLRLGESPHDAFDI

SEQ ID NO: 944 - protein, 125 aa, Homo sapiens
  source: /note="VH 1.89b"
EVQLVESGGGLVKPGGSLRLSCAASGFTFSDYSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 945 - protein, 5 aa, Homo sapiens
  source: /note="CDR1 sequence of SEQ ID NO: 948"
DVSMT

SEQ ID NO: 946 - protein, 17 aa, Homo sapiens
  source: /note="CDR2 sequence of SEQ ID NO: 948"
YISSGGGVKFYADSVKG

SEQ ID NO: 947 - protein, 16 aa, Homo sapiens
  source: /note="CDR3 sequence of SEQ ID NO: 948"
EAPLRLGESPHDAFDI

SEQ ID NO: 948 - protein, 125 aa, Homo sapiens
  source: /note="VH 1.90b"
EVQLVESGGGLVKPGGSLRLSCAASGFTFSDVSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 949 - protein, 5 aa, Homo sapiens
  source: /note="CDR1 sequence of SEQ ID NO: 952"
DQSMT

SEQ ID NO: 950 - protein, 17 aa, Homo sapiens
  source: /note="CDR2 sequence of SEQ ID NO: 952"
YISSGGGVKFYADSVKG

SEQ ID NO: 951 - protein, 16 aa, Homo sapiens
  source: /note="CDR3 sequence of SEQ ID NO: 952"
EAPLRLGESPHDAFDI

SEQ ID NO: 952 - protein, 125 aa, Homo sapiens
  source: /note="VH 1.91b"
EVQLVESGGGLVKPGGSLRLSCAASGFTFSDQSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 953 - protein, 5 aa, Homo sapiens
  source: /note="CDR1 sequence of SEQ ID NO: 956"
DESMT

SEQ ID NO: 954 - protein, 17 aa, Homo sapiens
  source: /note="CDR2 sequence of SEQ ID NO: 956"
YISSGGGVKFYADSVKG

SEQ ID NO: 955 - protein, 16 aa, Homo sapiens
  source: /note="CDR3 sequence of SEQ ID NO: 956"
EAPLRLGESPHDAFDI

SEQ ID NO: 956 - protein, 125 aa, Homo sapiens
  source: /note="VH 1.92b"
EVQLVESGGGLVKPGGSLRLSCAASGFTFSDESMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 957 - protein, 5 aa, Homo sapiens
  source: /note="CDR1 sequence of SEQ ID NO: 960"
DASMT

SEQ ID NO: 958 - protein, 17 aa, Homo sapiens
  source: /note="CDR2 sequence of SEQ ID NO: 960"
YISSGGGVKFYADSVKG

SEQ ID NO: 959 - protein, 16 aa, Homo sapiens
  source: /note="CDR3 sequence of SEQ ID NO: 960"
EAPLRLGESPHDAFDI

SEQ ID NO: 960 - protein, 125 aa, Homo sapiens
  source: /note="VH 1.93b"
EVQLVESGGGLVKPGGSLRLSCAASGFTFSDASMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 961 - protein, 5 aa, Homo sapiens
  source: /note="CDR1 sequence of SEQ ID NO: 964"
DWSMT

SEQ ID NO: 962 - protein, 17 aa, Homo sapiens
  source: /note="CDR2 sequence of SEQ ID NO: 964"
YISSGGGVKFYADSVKG

SEQ ID NO: 963 - protein, 16 aa, Homo sapiens
  source: /note="CDR3 sequence of SEQ ID NO: 964"
EAPLRLGESPHDAFDI

SEQ ID NO: 964 - protein, 125 aa, Homo sapiens
  source: /note="VH 1.94b"
EVQLVESGGGLVKPGGSLRLSCAASGFTFSDWSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 965 - protein, 5 aa, Homo sapiens
  source: /note="CDR1 sequence of SEQ ID NO: 968"
DGSMT

SEQ ID NO: 966 - protein, 17 aa, Homo sapiens
  source: /note="CDR2 sequence of SEQ ID NO: 968"
YISSGGGVKFYADSVKG

SEQ ID NO: 967 - protein, 16 aa, Homo sapiens
  source: /note="CDR3 sequence of SEQ ID NO: 968"
EAPLRLGESPHDAFDI

SEQ ID NO: 968 - protein, 125 aa, Homo sapiens
  source: /note="VH 1.95b"
EVQLVESGGGLVKPGGSLRLSCAASGFTFSDGSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 969 - protein, 5 aa, Homo sapiens
  source: /note="CDR1 sequence of SEQ ID NO: 972"
DTSMT

SEQ ID NO: 970 - protein, 17 aa, Homo sapiens
  source: /note="CDR2 sequence of SEQ ID NO: 972"
YISSGGGVKFYADSVKG

SEQ ID NO: 971 - protein, 16 aa, Homo sapiens
  source: /note="CDR3 sequence of SEQ ID NO: 972"
EAPLRLGESPHDAFDI

SEQ ID NO: 972 - protein, 125 aa, Homo sapiens
  source: /note="VH 1.96b"
EVQLVESGGGLVKPGGSLRLSCAASGFTFSDTSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 973 - protein, 5 aa, Homo sapiens
  source: /note="CDR1 sequence of SEQ ID NO: 976"
DISMT

SEQ ID NO: 974 - protein, 17 aa, Homo sapiens
  source: /note="CDR2 sequence of SEQ ID NO: 976"
YISSGGGVKFYADSVKG

SEQ ID NO: 975 - protein, 16 aa, Homo sapiens
  source: /note="CDR3 sequence of SEQ ID NO: 976"
EAPLRLGESPHDAFDI

SEQ ID NO: 976 - protein, 125 aa, Homo sapiens
  source: /note="VH 1.97b"
EVQLVESGGGLVKPGGSLRLSCAASGFTFSDISMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 977 - protein, 5 aa, Homo sapiens
  source: /note="CDR1 sequence of SEQ ID NO: 980"
DKSMT

SEQ ID NO: 978 - protein, 17 aa, Homo sapiens
  source: /note="CDR2 sequence of SEQ ID NO: 980"
YISSGGGVKFYADSVKG

SEQ ID NO: 979 - protein, 16 aa, Homo sapiens
  source: /note="CDR3 sequence of SEQ ID NO: 980"
EAPLRLGESPHDAFDI

SEQ ID NO: 980 - protein, 125 aa, Homo sapiens
  source: /note="VH 1.98b"
EVQLVESGGGLVKPGGSLRLSCAASGFTFSDKSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 981 - protein, 5 aa, Homo sapiens
  source: /note="CDR1 sequence of SEQ ID NO: 984"
DRSMT

SEQ ID NO: 982 - protein, 17 aa, Homo sapiens
  source: /note="CDR2 sequence of SEQ ID NO: 984"
YISSGGGVKFYADSVKG

SEQ ID NO: 983 - protein, 16 aa, Homo sapiens
  source: /note="CDR3 sequence of SEQ ID NO: 984"
EAPLRLGESPHDAFDI

SEQ ID NO: 984 - protein, 125 aa, Homo sapiens
  source: /note="VH 1.99b"
EVQLVESGGGLVKPGGSLRLSCAASGFTFSDRSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 985 - protein, 5 aa, Homo sapiens
  source: /note="CDR1 sequence of SEQ ID NO: 988"
DLSMT

SEQ ID NO: 986 - protein, 17 aa, Homo sapiens
  source: /note="CDR2 sequence of SEQ ID NO: 988"
YISSGGGVKFYADSVKG

SEQ ID NO: 987 - protein, 16 aa, Homo sapiens
  source: /note="CDR3 sequence of SEQ ID NO: 988"
EAPLRLGESPHDAFDI

SEQ ID NO: 988 - protein, 125 aa, Homo sapiens
  source: /note="VH 1.100b"
EVQLVESGGGLVKPGGSLRLSCAASGFTFSDLSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 989 - protein, 5 aa, Homo sapiens
  source: /note="CDR1 sequence of SEQ ID NO: 992"
DFSMT

SEQ ID NO: 990 - protein, 17 aa, Homo sapiens
  source: /note="CDR2 sequence of SEQ ID NO: 992"
YISSGGGVKFYADSVKG

SEQ ID NO: 991 - protein, 16 aa, Homo sapiens
  source: /note="CDR3 sequence of SEQ ID NO: 992"
EAPLRLGESPHDAFDI

SEQ ID NO: 992 - protein, 125 aa, Homo sapiens
  source: /note="VH 1.101b"
EVQLVESGGGLVKPGGSLRLSCAASGFTFSDFSMTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 993 - protein, 5 aa, Homo sapiens
  source: /note="CDR1 sequence of SEQ ID NO: 996"
DESVT

SEQ ID NO: 994 - protein, 17 aa, Homo sapiens
  source: /note="CDR2 sequence of SEQ ID NO: 996"
YISSGGGVKFYTDSVKG

SEQ ID NO: 995 - protein, 16 aa, Homo sapiens
  source: /note="CDR3 sequence of SEQ ID NO: 996"
EAPLRLGESPHDAFDI

SEQ ID NO: 996 - protein, 125 aa, Homo sapiens
  source: /note="VH 1.102b"
EVQLVESGGGLVKPGGSLRLSCAASGFTFSDESVTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 997 - protein, 5 aa, Homo sapiens
  source: /note="CDR1 sequence of SEQ ID NO: 1000"
DESQT

SEQ ID NO: 998 - protein, 17 aa, Homo sapiens
  source: /note="CDR2 sequence of SEQ ID NO: 1000"
YISSGGGVKFYTDSVKG

SEQ ID NO: 999 - protein, 16 aa, Homo sapiens
  source: /note="CDR3 sequence of SEQ ID NO: 1000"
EAPLRLGESPHDAFDI

SEQ ID NO: 1000 - protein, 125 aa, Homo sapiens
  source: /note="VH 1.103b"
EVQLVESGGGLVKPGGSLRLSCAASGFTFSDESQTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 1001 - protein, 5 aa, Homo sapiens
  source: /note="CDR1 sequence of SEQ ID NO: 1004"
DESFT

SEQ ID NO: 1002 - protein, 17 aa, Homo sapiens
  source: /note="CDR2 sequence of SEQ ID NO: 1004"
YISSGGGVKFYTDSVKG

SEQ ID NO: 1003 - protein, 16 aa, Homo sapiens
  source: /note="CDR3 sequence of SEQ ID NO: 1004"
EAPLRLGESPHDAFDI

SEQ ID NO: 1004 - protein, 125 aa, Homo sapiens
  source: /note="VH 1.104b"
EVQLVESGGGLVKPGGSLRLSCAASGFTFSDESFTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 1005 - protein, 5 aa, Homo sapiens
  source: /note="CDR1 sequence of SEQ ID NO: 1008"
DESLT

SEQ ID NO: 1006 - protein, 17 aa, Homo sapiens
  source: /note="CDR2 sequence of SEQ ID NO: 1008"
YISSGGGVKFYTDSVKG

SEQ ID NO: 1007 - protein, 16 aa, Homo sapiens
  source: /note="CDR3 sequence of SEQ ID NO: 1008"
EAPLRLGESPHDAFDI

SEQ ID NO: 1008 - protein, 125 aa, Homo sapiens
  source: /note="VH 1.105b"
EVQLVESGGGLVKPGGSLRLSCAASGFTFSDESLTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 1009 - protein, 5 aa, Homo sapiens
  source: /note="CDR1 sequence of SEQ ID NO: 1012"
DESKT

SEQ ID NO: 1010 - protein, 17 aa, Homo sapiens
  source: /note="CDR2 sequence of SEQ ID NO: 1012"
YISSGGGVKFYTDSVKG

SEQ ID NO: 1011 - protein, 16 aa, Homo sapiens
  source: /note="CDR3 sequence of SEQ ID NO: 1012"
EAPLRLGESPHDAFDI

SEQ ID NO: 1012 - protein, 125 aa, Homo sapiens
  source: /note="VH 1.106b"
EVQLVESGGGLVKPGGSLRLSCAASGFTFSDESKTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 1013 - protein, 5 aa, Homo sapiens
  source: /note="CDR1 sequence of SEQ ID NO: 1016"
DESYT

SEQ ID NO: 1014 - protein, 17 aa, Homo sapiens
  source: /note="CDR2 sequence of SEQ ID NO: 1016"
YISSGGGVKFYTDSVKG

SEQ ID NO: 1015 - protein, 16 aa, Homo sapiens
  source: /note="CDR3 sequence of SEQ ID NO: 1016"
EAPLRLGESPHDAFDI

SEQ ID NO: 1016 - protein, 125 aa, Homo sapiens
  source: /note="VH 1.107b"
EVQLVESGGGLVKPGGSLRLSCAASGFTFSDESYTWMRQAPGKGLEWVSYISSGGGVKFYTDSVKGRFTISRDNAKNSLYLQMNSLRAEDTAVYYCAREAPLRLGESPHDAFDISGQGTMVTVSS

SEQ ID NO: 1017 - protein, 5 aa, Homo sapiens
  source: /note="CDR1 sequence of SEQ ID NO: 1020"
DESAT

SEQ ID NO: 1018 - protein, 17 aa, Homo sapiens
  source: /note="CDR2 sequence of SEQ ID NO: 1020"
YISSGGGVKFYADSVKG

SEQ ID NO: 1019 - protein, 16 aa, Homo sapiens
  source: /note="CDR3 sequence of SEQ ID NO: 1020"
EAPLRLGESPHDAFDI

SEQ ID NO: 1020 - protein, 125 aa, Homo sapiens
  source: /note="VH 1.108b"
EVQLVESGGGLVKPGGSLRLSCAASGFTFSDESATWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 1021 - protein, 5 aa, Homo sapiens
  source: /note="CDR1 sequence of SEQ ID NO: 1024"
DESFT

SEQ ID NO: 1022 - protein, 17 aa, Homo sapiens
  source: /note="CDR2 sequence of SEQ ID NO: 1024"
YISSGGGVKFYADSVKG

SEQ ID NO: 1023 - protein, 16 aa, Homo sapiens
  source: /note="CDR3 sequence of SEQ ID NO: 1024"
EAPLRLGESPHDAFDI

SEQ ID NO: 1024 - protein, 125 aa, Homo sapiens
  source: /note="VH 1.109b"
EVQLVESGGGLVKPGGSLRLSCAASGFTFSDESFTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 1025 - protein, 5 aa, Homo sapiens
  source: /note="CDR1 sequence of SEQ ID NO: 1028"
DESNT

SEQ ID NO: 1026 - protein, 17 aa, Homo sapiens
  source: /note="CDR2 sequence of SEQ ID NO: 1028"
YISSGGGVKFYADSVKG

SEQ ID NO: 1027 - protein, 16 aa, Homo sapiens
  source: /note="CDR3 sequence of SEQ ID NO: 1028"
EAPLRLGESPHDAFDI

SEQ ID NO: 1028 - protein, 125 aa, Homo sapiens
  source: /note="VH 1.110b"
EVQLVESGGGLVKPGGSLRLSCAASGFTFSDESNTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 1029 - protein, 5 aa, Homo sapiens
  source: /note="CDR1 sequence of SEQ ID NO: 1032"
DESWT

SEQ ID NO: 1030 - protein, 17 aa, Homo sapiens
  source: /note="CDR2 sequence of SEQ ID NO: 1032"
YISSGGGVKFYADSVKG

SEQ ID NO: 1031 - protein, 16 aa, Homo sapiens
  source: /note="CDR3 sequence of SEQ ID NO: 1032"
EAPLRLGESPHDAFDI

SEQ ID NO: 1032 - protein, 125 aa, Homo sapiens
  source: /note="VH 1.111b"
EVQLVESGGGLVKPGGSLRLSCAASGFTFSDESWTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 1033 - protein, 5 aa, Homo sapiens
  source: /note="CDR1 sequence of SEQ ID NO: 1036"
DESIT

SEQ ID NO: 1034 - protein, 17 aa, Homo sapiens
  source: /note="CDR2 sequence of SEQ ID NO: 1036"
YISSGGGVKFYADSVKG

SEQ ID NO: 1035 - protein, 16 aa, Homo sapiens
  source: /note="CDR3 sequence of SEQ ID NO: 1036"
EAPLRLGESPHDAFDI

SEQ ID NO: 1036 - protein, 125 aa, Homo sapiens
  source: /note="VH 1.112b"
EVQLVESGGGLVKPGGSLRLSCAASGFTFSDESITWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 1037 - protein, 5 aa, Homo sapiens
  source: /note="CDR1 sequence of SEQ ID NO: 1040"
DESST

SEQ ID NO: 1038 - protein, 17 aa, Homo sapiens
  source: /note="CDR2 sequence of SEQ ID NO: 1040"
YISSGGGVKFYADSVKG

SEQ ID NO: 1039 - protein, 16 aa, Homo sapiens
  source: /note="CDR3 sequence of SEQ ID NO: 1040"
EAPLRLGESPHDAFDI

SEQ ID NO: 1040 - protein, 125 aa, Homo sapiens
  source: /note="VH 1.113b"
EVQLVESGGGLVKPGGSLRLSCAASGFTFSDESSTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 1041 - protein, 5 aa, Homo sapiens
  source: /note="CDR1 sequence of SEQ ID NO: 1044"
DESHT

SEQ ID NO: 1042 - protein, 17 aa, Homo sapiens
  source: /note="CDR2 sequence of SEQ ID NO: 1044"
YISSGGGVKFYADSVKG

SEQ ID NO: 1043 - protein, 16 aa, Homo sapiens
  source: /note="CDR3 sequence of SEQ ID NO: 1044"
EAPLRLGESPHDAFDI

SEQ ID NO: 1044 - protein, 125 aa, Homo sapiens
  source: /note="VH 1.114b"
EVQLVESGGGLVKPGGSLRLSCAASGFTFSDESHTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 1045 - protein, 5 aa, Homo sapiens
  source: /note="CDR1 sequence of SEQ ID NO: 1048"
DESGT

SEQ ID NO: 1046 - protein, 17 aa, Homo sapiens
  source: /note="CDR2 sequence of SEQ ID NO: 1048"
YISSGGGVKFYADSVKG

SEQ ID NO: 1047 - protein, 16 aa, Homo sapiens
  source: /note="CDR3 sequence of SEQ ID NO: 1048"
EAPLRLGESPHDAFDI

SEQ ID NO: 1048 - protein, 125 aa, Homo sapiens
  source: /note="VH 1.115b"
EVQLVESGGGLVKPGGSLRLSCAASGFTFSDESGTWMRQAPGKGLEWVSYISSGGGVKFYADSVKGRFTISRDNAKNSLYLQMNSLRAEDTAVYYCAREAPLRLGESPHDAFDISGQGTMVTVSS

SEQ ID NO: 1049 - DNA, 375 bp, Homo sapiens
  source: /note="VH 1.74b"
gaggtgcagctggtggagtctgggggaggcttggtcaagcctggagggtccctgagactctcctgtgcagcctctggattcaccttcagtgacagctccatgacctggattcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaagggacaatggtcaccgtctcctca

SEQ ID NO: 1050 - DNA, 375 bp, Homo sapiens
  source: /note="VH 1.75b"
gaggtgcagctggtggagtctgggggaggcttggtcaagcctggagggtccctgagactctcctgtgcagcctctggattcaccttcagtgacagctccatgacctggattcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1051 - DNA, 375 bp, Homo sapiens
  source: /note="VH 1.76b"
gaggtgcagctggtggagtctgggggaggcttggtcaagcctggagggtccctgagactctcctgtgcagcctctggattcaccttcagtgacagctccatgacctggattcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgacgacacggccgtgtattactgtgcgcgagaggcccctttacgtttgggggagtccccccatgatgcttttgatatctcgggccaagggacaatggtcaccgtctcctca

SEQ ID NO: 1052 - DNA, 375 bp, Homo sapiens
  source: /note="VH 1.77b"
gaggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1053 - DNA, 375 bp, Homo sapiens
  source: /note="VH 1.78b"
gaggtgcagctggtggagtctgggggaggcttggtcaagcctggagggtccctgagactctcctgtgcagcctctggattcaccttcagtgacagctccatgacctggattcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1054 - DNA, 375 bp, Homo sapiens
  source: /note="VH 1.79b"
gaggtgcagctggtggagtctgggggaggcttggtcaagcctggagggtccctgagactctcctgtgcagcctctggattcaccttcagtgacagctccatgacctggaagcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1055 - DNA, 375 bp, Homo sapiens
  source: /note="VH 1.80b"
gaggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1056 - DNA, 375 bp, Homo sapiens
  source: /note="VH 1.81b"
gaggtgcagctggtggagtctgggggaggcttggtcaagcctggagggtccctgagactctcctgtgcagcctctggattcaccttcagtgacagctccatgacctgggtgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1057 - DNA, 375 bp, Homo sapiens
  source: /note="VH 1.82b"
gaggtgcagctggtggagtctgggggaggcttggtcaagcctggagggtccctgagactctcctgtgcagcctctggattcaccttcagtgacacctccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1058 - DNA, 375 bp, Homo sapiens
  source: /note="VH 1.83b"
gaggtgcagctggtggagtctgggggaggcttggtcaagcctggagggtccctgagactctcctgtgcagcctctggattcaccttcagtgacgaatccatgacctggtttcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1059 - DNA, 375 bp, Homo sapiens
  source: /note="VH 1.84b"
gaggtgcagctggtggagtctgggggaggcttggtcaagcctggagggtccctgagactctcctgtgcagcctctggattcaccttcagtgacgaatccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1060 - DNA, 375 bp, Homo sapiens
  source: /note="VH 1.85b"
gaggtgcagctggtggagtctgggggaggcttggtcaagcctggagggtccctgagactctcctgtgcagcctctggattcaccttcagtgactattccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1061 - DNA, 375 bp, Homo sapiens
  source: /note="VH 1.86b"
gaggtgcagctggtggagtctgggggaggcttggtcaagcctggagggtccctgagactctcctgtgcagcctctggattcaccttcagtgacgcctccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1062 - DNA, 375 bp, Homo sapiens
  source: /note="VH 1.87b"
gaggtgcagctggtggagtctgggggaggcttggtcaagcctggagggtccctgagactctcctgtgcagcctctggattcaccttcagtgacaaatccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1063 - DNA, 375 bp, Homo sapiens
  source: /note="VH 1.88b"
gaggtgcagctggtggagtctgggggaggcttggtcaagcctggagggtccctgagactctcctgtgcagcctctggattcaccttcagtgaccgttccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1064 - DNA, 375 bp, Homo sapiens
  source: /note="VH 1.89b"
gaggtgcagctggtggagtctgggggaggcttggtcaagcctggagggtccctgagactctcctgtgcagcctctggattcaccttcagtgactattccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1065 - DNA, 375 bp, Homo sapiens
  source: /note="VH 1.90b"
gaggtgcagctggtggagtctgggggaggcttggtcaagcctggagggtccctgagactctcctgtgcagcctctggattcaccttcagtgacgtgtccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1066 - DNA, 375 bp, Homo sapiens
  source: /note="VH 1.91b"
gaggtgcagctggtggagtctgggggaggcttggtcaagcctggagggtccctgagactctcctgtgcagcctctggattcaccttcagtgaccagtccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1067 - DNA, 375 bp, Homo sapiens
  source: /note="VH 1.92b"
gaggtgcagctggtggagtctgggggaggcttggtcaagcctggagggtccctgagactctcctgtgcagcctctggattcaccttcagtgacgaatccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1068 - DNA, 375 bp, Homo sapiens
  source: /note="VH 1.93b"
gaggtgcagctggtggagtctgggggaggcttggtcaagcctggagggtccctgagactctcctgtgcagcctctggattcaccttcagtgacgcctccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1069 - DNA, 375 bp, Homo sapiens
  source: /note="VH 1.94b"
gaggtgcagctggtggagtctgggggaggcttggtcaagcctggagggtccctgagactctcctgtgcagcctctggattcaccttcagtgactggtccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1070 - DNA, 375 bp, Homo sapiens
  source: /note="VH 1.95b"
gaggtgcagctggtggagtctgggggaggcttggtcaagcctggagggtccctgagactctcctgtgcagcctctggattcaccttcagtgacggctccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1071 - DNA, 375 bp, Homo sapiens
  source: /note="VH 1.96b"
gaggtgcagctggtggagtctgggggaggcttggtcaagcctggagggtccctgagactctcctgtgcagcctctggattcaccttcagtgacacctccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1072 - DNA, 375 bp, Homo sapiens
  source: /note="VH 1.97b"
gaggtgcagctggtggagtctgggggaggcttggtcaagcctggagggtccctgagactctcctgtgcagcctctggattcaccttcagtgacatttccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1073 - DNA, 375 bp, Homo sapiens
  source: /note="VH 1.98b"
gaggtgcagctggtggagtctgggggaggcttggtcaagcctggagggtccctgagactctcctgtgcagcctctggattcaccttcagtgacaaatccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1074 - DNA, 375 bp, Homo sapiens
  source: /note="VH 1.99b"
gaggtgcagctggtggagtctgggggaggcttggtcaagcctggagggtccctgagactctcctgtgcagcctctggattcaccttcagtgaccgttccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1075 - DNA, 375 bp, Homo sapiens
  source: /note="VH 1.100b"
gaggtgcagctggtggagtctgggggaggcttggtcaagcctggagggtccctgagactctcctgtgcagcctctggattcaccttcagtgacctgtccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1076 - DNA, 375 bp, Homo sapiens
  source: /note="VH 1.101b"
gaggtgcagctggtggagtctgggggaggcttggtcaagcctggagggtccctgagactctcctgtgcagcctctggattcaccttcagtgacttttccatgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1077 - DNA, 375 bp, Homo sapiens
  source: /note="VH 1.102b"
gaggtgcagctggtggagtctgggggaggcttggtcaagcctggagggtccctgagactctcctgtgcagcctctggattcaccttcagtgacgaatccgtgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1078 - DNA, 375 bp, Homo sapiens
  source: /note="VH 1.103b"
gaggtgcagctggtggagtctgggggaggcttggtcaagcctggagggtccctgagactctcctgtgcagcctctggattcaccttcagtgacgaatcccagacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1079 - DNA, 375 bp, Homo sapiens
  source: /note="VH 1.104b"
gaggtgcagctggtggagtctgggggaggcttggtcaagcctggagggtccctgagactctcctgtgcagcctctggattcaccttcagtgacgaatcctttacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1080 - DNA, 375 bp, Homo sapiens
  source: /note="VH 1.105b"
gaggtgcagctggtggagtctgggggaggcttggtcaagcctggagggtccctgagactctcctgtgcagcctctggattcaccttcagtgacgaatccctgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1081 - DNA, 375 bp, Homo sapiens
  source: /note="VH 1.106b"
gaggtgcagctggtggagtctgggggaggcttggtcaagcctggagggtccctgagactctcctgtgcagcctctggattcaccttcagtgacgaatccaaaacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1082 - DNA, 375 bp, Homo sapiens
  source: /note="VH 1.107b"
gaggtgcagctggtggagtctgggggaggcttggtcaagcctggagggtccctgagactctcctgtgcagcctctggattcaccttcagtgacgaatcctatacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1083 - DNA, 375 bp, Homo sapiens
  source: /note="VH 1.108b"
gaggtgcagctggtggagtctgggggaggcttggtcaagcctggagggtccctgagactctcctgtgcagcctctggattcaccttcagtgacgaatccgcgacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1084 - DNA, 375 bp, Homo sapiens
  source: /note="VH 1.109b"
gaggtgcagctggtggagtctgggggaggcttggtcaagcctggagggtccctgagactctcctgtgcagcctctggattcaccttcagtgacgaatccttcacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1085 - DNA, 375 bp, Homo sapiens
  source: /note="VH 1.110b"
gaggtgcagctggtggagtctgggggaggcttggtcaagcctggagggtccctgagactctcctgtgcagcctctggattcaccttcagtgacgaatccaacacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1086 - DNA, 375 bp, Homo sapiens
  source: /note="VH 1.111b"
gaggtgcagctggtggagtctgggggaggcttggtcaagcctggagggtccctgagactctcctgtgcagcctctggattcaccttcagtgacgaatcctggacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1087 - DNA, 375 bp, Homo sapiens
  source: /note="VH 1.112b"
gaggtgcagctggtggagtctgggggaggcttggtcaagcctggagggtccctgagactctcctgtgcagcctctggattcaccttcagtgacgaatccatcacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1088 - DNA, 375 bp, Homo sapiens
  source: /note="VH 1.113b"
gaggtgcagctggtggagtctgggggaggcttggtcaagcctggagggtccctgagactctcctgtgcagcctctggattcaccttcagtgacgaatccagcacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1089 - DNA, 375 bp, Homo sapiens
  source: /note="VH 1.114b"
gaggtgcagctggtggagtctgggggaggcttggtcaagcctggagggtccctgagactctcctgtgcagcctctggattcaccttcagtgacgaatcccacacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1090 - DNA, 375 bp, Homo sapiens
  source: /note="VH 1.115b"
gaggtgcagctggtggagtctgggggaggcttggtcaagcctggagggtccctgagactctcctgtgcagcctctggattcaccttcagtgacgaatccgggacctggatgcggcaggctccagggaaggggctggagtgggtttcctacataagttctggtggtggtgtcaaattttacgcagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctca

SEQ ID NO: 1091 - protein, 5 aa, Homo sapiens
  source: /note="Termination sequence of a human VH domain"
VTVSS

SEQ ID NO: 1092 - protein, 6 aa, Artificial Sequence
  source: /note="Description of Artificial Sequence: Synthetic 6xHis tag"
HHHHHH

SEQ ID NO: 1093 - protein, 288 aa, Homo sapiens
  source: /note="Wild type human PD-1 protein"
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 1094 - protein, 14 aa, Homo sapiens
  source: /note="Residues 102-115 of human PD-1"
NGRDFHMSVVRARR

SEQ ID NO: 1095 - protein, 6 aa, Homo sapiens
  source: /note="Binding motif in human PD-1"
NPPTFS

SEQ ID NO: 1096 - protein, 14 aa, Homo sapiens
  source: /note="Binding motif in human PD-1"
CSFSNTSESFVLNW

SEQ ID NO: 1097 - protein, 10 aa, Homo sapiens
  source: /note="Binding motif in human PD-1"
PNGRDFHMSV

SEQ ID NO: 1098 - protein, 12 aa, Homo sapiens
  source: /note="Binding motif in human PD-1"
SESFVLNWYRMS

SEQ ID NO: 1099 - protein, 9 aa, Homo sapiens
  source: /note="Binding motif in human PD-1"
GQDCRFRVT

SEQ ID NO: 1100 - protein, 11 aa, Homo sapiens
  source: /note="Binding motif in human PD-1"
RDFHMSVVRAR

SEQ ID NO: 1101 - protein, 7 aa, Homo sapiens
  source: /note="Binding motif in human PD-1"
RDFHMSV

SEQ ID NO: 1102 - protein, 14 aa, Mus sp.
  source: /note="Murine PD-1"
NRHDFHMNILDTRR

SEQ ID NO: 1103 - protein, 10 aa, Artificial Sequence
  source: /note="Description of Artificial Sequence: Synthetic 2GS linker sequence"
GGGGSGGGGS

SEQ ID NO: 1104 - DNA, 30 bp, Artificial Sequence
  source: /note="Description of Artificial Sequence: Synthetic 2GS linker sequence"
ggaggtggaggttcaggtggaggtggtagt

SEQ ID NO: 1105 - protein, 20 aa, Artificial Sequence
  source: /note="Description of Artificial Sequence: Synthetic 4GS linker sequence"
GGGGSGGGGSGGGGSGGGGS

SEQ ID NO: 1106 - DNA, 60 bp, Artificial Sequence
  source: /note="Description of Artificial Sequence: Synthetic 4GS linker sequence"
ggaggtggaggttcaggaggtggtggttctggtggtggcggttcaggtggaggtggtagt

SEQ ID NO: 1107 - protein, 30 aa, Artificial Sequence
  source: /note="Description of Artificial Sequence: Synthetic 6GS linker sequence"
GGGGSGGGGSGGGGSGGGGSGGGGSGGGGS

SEQ ID NO: 1108 - DNA, 90 bp, Artificial Sequence
  source: /note="Description of Artificial Sequence: Synthetic 6GS linker sequence"
ggtggtggcggttcaggcggaggtggctctggaggtggaggttcaggaggtggtggttctggcggcggtggatcgggtggaggtggtagt

SEQ ID NO: 1109 - protein, 45 aa, Artificial Sequence
  source: /note="Description of Artificial Sequence: Synthetic 9GS linker sequence"
GGGGSGGGGSGGGGSGGGGSGGGGSGGGGSGGGGSGGGGSGGGGS

SEQ ID NO: 1110 - DNA, 135 bp, Artificial Sequence
  source: /note="Description of Artificial Sequence: Synthetic 9GS linker sequence"
ggaggtggaggttcaggaggtggtggttctggtggtggcggttcaggtggaggtggtagtggaggaggtggttctggcggaggaggatcgggtggaggtggctcaggtggtggaggtagtggaggcggtggcagc

SEQ ID NO: 1111 - DNA, 816 bp, Artificial Sequence
  source: /note="Description of Artificial Sequence: Synthetic polynucleotide"
  source: /note="1.92b-4GS-1.39a polynucleotide"
gaggttcagctagtggagagcggtggtggccttgtgaaacctggtggttccctgagactttcctgtgcagcttccggttttaccttcagcgatgaatctatgacatggatgcgacaagctccaggtaagggattggaatgggtttcatatatcagctcgggaggtggagtgaaattttatgccgactctgtaaagggtagattcactatttcaagagacaacgcaaaaaactccttgtatttacaaatgaattctctcagagccgaggacacagctgtctactactgtgctagagaagcaccacttagactgggtgaatctccacatgatgcctttgacatatcaggacaagggacaatggtcacagtcagtagcggtggcgggggatctggtggtggtggctctggaggtggtggttcaggcggaggcggaagtgaggtgcagctggtggagtctgggggaggcttggtacagcctggcaggtccctgagactctcctgtgcagcctctggattcacctttgacgattatgccctacactgggtccggcaagctccagggaaggacctggagtgggtctcaggtattagttggaatggtggtagctacggctacgcggactctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgcctggggccaagggaccatggtcaccgtctcctca

SEQ ID NO: 1112 - protein, 272 aa, Artificial Sequence
  source: /note="Description of Artificial Sequence: Synthetic polypeptide"
  source: /note="1.92b-4GS-1.39a polypeptide"
EVQLVESGGGLVKPGGSLRLSCAASGFTFSDESMTWMRQAPGKGLEWVSYISSGGGVKFYADSVKGRFTISRDNAKNSLYLQMNSLRAEDTAVYYCAREAPLRLGESPHDAFDISGQGTMVTVSSGGGGSGGGGSGGGGSGGGGSEVQLVESGGGLVQPGRSLRLSCAASGFTFDDYALHWVRQAPGKDLEWVSGISWNGGSYGYADSVKGRFTISRDNAKNSLYLQMNSLRAEDTALYYCVREKGPGLTGSTADYYGLDAWGQGTMVTVSS

SEQ ID NO: 1113 - DNA, 798 bp, Artificial Sequence
  source: /note="Description of Artificial Sequence: Synthetic polynucleotide"
  source: /note="1.92b-4GS-1.62a polynucleotide"
cagctagtggagagcggtggtggccttgtgaaacctggtggttccctgagactttcctgtgcagcttccggttttaccttcagcgatgaatctatgacatggatgcgacaagctccaggtaagggattggaatgggtttcatatatcagctcgggaggtggagtgaaattttatgccgactctgtaaagggtagattcactatttcaagagacaacgcaaaaaactccttgtatttacaaatgaattctctcagagccgaggacacagctgtctactactgtgctagagaagcaccacttagactgggtgaatctccacatgatgcctttgacatatcaggacaagggacaatggtcacagtcagtagcggtggcgggggatctggtggtggtggctctggaggtggtggttcaggcggaggcggaagtgaggtgcagctggtggagtctgggggaggtgtggtacggcctggggggtccctgagactctcctgtgcagcctctggattcacctttgatgattatgccatgagttgggtccgccaagctccagggaaggggctggagtgggtctctggtattacttggaatgccggtagcacaggttatgcagactctgtgaagggccgattcaccatctccagagacaacgccaagaactccctgtatctgcaaatgaacagtctgagagccgaggacacggccttgtattactgtgtgagagacaagtatagctatgcctggtcttatgatgattttgatatctggggccaagggacaatggtcaccgtctcctca

SEQ ID NO: 1114 - protein, 268 aa, Artificial Sequence
  source: /note="Description of Artificial Sequence: Synthetic polypeptide"
  source: /note="1.92b-4GS-1.62a polypeptide"
EVQLVESGGGLVKPGGSLRLSCAASGFTFSDESMTWMRQAPGKGLEWVSYISSGGGVKFYADSVKGRFTISRDNAKNSLYLQMNSLRAEDTAVYYCAREAPLRLGESPHDAFDISGQGTMVTVSSGGGGSGGGGSGGGGSGGGGSEVQLVESGGGVVRPGGSLRLSCAASGFTFDDYAMSWVRQAPGKGLEWVSGITWNAGSTGYADSVKGRFTISRDNAKNSLYLQMNSLRAEDTALYYCVRDKYSYAWSYDDFDIWGQGTMVTVSS

SEQ ID NO: 1115 - DNA, 816 bp, Artificial Sequence
  source: /note="Description of Artificial Sequence: Synthetic polynucleotide"
  source: /note="1.77b-4GS-1.21a polynucleotide"
gaggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctcaggaggtggaggttcaggaggtggtggttctggtggtggcggttcaggtggaggtggtagtgaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgtctggggccaagggaccatggtcaccgtctcctca

SEQ ID NO: 1116 - protein, 272 aa, Artificial Sequence
  source: /note="Description of Artificial Sequence: Synthetic polypeptide"
  source: /note="1.77b-4GS-1.21a polypeptide"
EVQLVESGGGLVKPGGSLRLSCAASGFTFSDSSMTWMRQAPGKGLEWVSYISSGGGVKFYTDSVKGRFTISRDNAKNSLYLQMNSLRAEDTAVYYCAREAPLRLGESPHDAFDISGQGTMVTVSSGGGGSGGGGSGGGGSGGGGSEVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVREKGPGLTGSTADYYGLDVWGQGTMVTVSS

SEQ ID NO: 1117 - DNA, 777 bp, Artificial Sequence
  source: /note="Description of Artificial Sequence: Synthetic polynucleotide"
  source: /note="1.77b-1GS-1.21a polynucleotide"
gaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgtctggggccaagggaccatggtcaccgtctcctcaggtggaggtggtagtgaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgtctggggccaagggaccatggtcaccgtctcctca

SEQ ID NO: 1118 - protein, 257 aa, Artificial Sequence
  source: /note="Description of Artificial Sequence: Synthetic polypeptide"
  source: /note="1.77b-1GS-1.21a polypeptide"
EVQLVESGGGLVKPGGSLRLSCAASGFTFSDSSMTWMRQAPGKGLEWVSYISSGGGVKFYTDSVKGRFTISRDNAKNSLYLQMNSLRAEDTAVYYCAREAPLRLGESPHDAFDISGQGTMVTVSSGGGGSEVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVREKGPGLTGSTADYYGLDVWGQGTMVTVSS

SEQ ID NO: 1119 - DNA, 786 bp, Artificial Sequence
  source: /note="Description of Artificial Sequence: Synthetic polynucleotide"
  source: /note="1.77b-2GS-1.21a polynucleotide"
gaggtgcagctggtggagtctgggggaggcttggtcaagcctggagggtccctgagactctcctgtgcagcctctggattcaccttcagtgacagctccatgacctggatgcggcaggctccagggaaggggctggagtgggtttcctacataagttctggtggtggtgtcaaattttacacagactctgtgaagggccgattcaccatctccagggacaacgccaagaactcactgtatctgcaaatgaacagcctgagagccgaagacacggccgtgtattactgtgcgcgagaggcccctttacgtttgggggagtccccccatgatgcttttgatatctcgggccaagggacaatggtcaccgtctcctcaggaggtggaggttcaggtggaggtggtagtgaggtgcagctggtggagtctgggggaggcttggtacagcctggcaggtccctgagactctcctgtgcagcctctggattcacctttgacgattatgccatgcactgggtccggcaagctccagggaaggacctggagtgggtctcaggtattagttggaatggtggtagcatgggctacgcggcctctgtgaagggccgattcaccatctccagagacaacgccaagaactccctgtatctgcaaatgaacagtctgagagctgaggacacggccttgtattattgtgtaagagaaaaggggcccggcttaactggaagtacggccgattactacggtttggacgtctggggccaagggaccatggtcaccgtctcctca

SEQ ID NO: 1120 - protein, 262 aa, Artificial Sequence
  source: /note="Description of Artificial Sequence: Synthetic polypeptide"
  source: /note="1.77b-2GS-1.21a polypeptide"
EVQLVESGGGLVKPGGSLRLSCAASGFTFSDSSMTWMRQAPGKGLEWVSYISSGGGVKFYTDSVKGRFTISRDNAKNSLYLQMNSLRAEDTAVYYCAREAPLRLGESPHDAFDISGQGTMVTVSSGGGGSGGGGSEVQLVESGGGLVQPGRSLRLSCAASGFTFDDYAMHWVRQAPGKDLEWVSGISWNGGSMGYAASVKGRFTISRDNAKNSLYLQMNSLRAEDTALYYCVREKGPGLTGSTADYYGLDVWGQGTMVTVSS

The invention claimed is:

1. An isolated binding agent comprising a) a first single domain antibody directed against a first epitope of human PD-1 and b) a second single domain antibody directed against a second epitope of human PD-1, wherein said first single domain antibody does not block the interaction of human PD-1 with human PD-L1 and/or PD-L2 and wherein said second single domain antibody blocks the interaction of human PD-1 with human PD-L1 and/or PD-L2 wherein said first single domain antibody binds to an epitope comprising amino acid residues 33-NPPTFS-38 (SEQ ID NO: 1095), 54-CSFSNTSESFVLNW-67 (SEQ ID NO: 1096) and 101-PNGRDFHMSV-110 (SEQ ID NO: 1097) or comprising amino acid residues 60-SESFVLNWYRMS-71 (SEQ ID NO: 1098), 90-GQDCRFRVT-98 (SEQ ID NO: 1099) and 104-RDFHMSVVRAR-114 (SEQ ID NO: 1110).

2. The isolated binding agent according to claim 1, wherein said domain of the single domain antibody is a human heavy chain variable domain ($V_H$).

3. The isolated binding agent according to claim 1,
wherein said first single domain antibody comprises a CDR1, CDR2 and CDR3 selected from CDRs1-3 of SEQ ID NOs: 4, 8, 12, 16, 20, 24, 28, 32, 36, 40, 44, 48, 52, 56, 60, 64, 68, 72, 76, 80, 104, 108, 112, 116, 120, 124, 128, 132, 136, 140, 144, 148, 152, 156, 160, 164, 168, 172, 176, 180, 184, 188, 192, 196, 200, 204, 208, 212, 216 and 220, and/or
wherein said first single domain antibody comprises a sequence selected from SEQ ID NOs: 4, 8, 12, 16, 20, 24, 28, 32, 36, 40, 44, 48, 52, 56, 60, 64, 68, 72, 76, 80, 104, 108, 112, 116, 120, 124, 128, 132, 136, 140, 144, 148, 152, 156, 160, 164, 168, 172, 176, 180, 184, 188, 192, 196, 200, 204, 208, 212, 216 and 220.

4. The isolated binding agent according to claim 1,
wherein said first single domain antibody comprises a CDR1, CDR2 and CDR3 selected from CDRs1-3 of SEQ ID NOs: 254, 258, 262, 266, 270, 274, 278, 282, 286, 290, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, 434, 438, 442, 446, 450, 454, 458 and 462, and/or
wherein said first single domain antibody comprises a sequence selected from SEQ ID NOs: 254, 258, 262, 266, 270, 274, 278, 282, 286, 290, 294, 298, 302, 306, 310, 314, 318, 322, 326, 330, 334, 338, 342, 346, 350, 354, 358, 362, 366, 370, 374, 378, 382, 386, 390, 394, 398, 402, 406, 410, 414, 418, 422, 426, 430, 434, 438, 442, 446, 450, 454, 458 and 462.

5. The isolated binding agent according to claim 1,
wherein said second single domain antibody comprises a CDR1, CDR2 and CDR3 selected from CDRs1-3 of SEQ ID NOs: 519, 523, 527, 531, 535, 539, 543, 547, 551, 555, 559, 563, 567, 571, 575, 579, 583, 587, 591, 595, 599, 603, 607, 611, 615, 619, 623, 627, 631, 635, 639, 643, 647, 651, 655, 659, 663, 667, 671, 675, 679, 683, 687, 691, 695, 699, 703, 707, 711, 715, 719, 723, 727, 731, 735, 739, 743, 747, 751, 755, 759, 763, 767, 771, 775, 779, 783, 787, 791, 795, 799, 803, 807, 884, 888, 892, 896, 900, 904, 908, 912, 916, 920, 924, 928, 932, 936, 940, 944, 948, 952, 956, 960, 964, 968, 972, 976, 980, 984, 988, 992, 996, 1000, 1004, 1008, 1012, 1016, 1020, 1024, 1028, 1032, 1036, 1040, 1044 and 1048, and/or
wherein said second single domain antibody comprises a sequence selected from SEQ ID NOs: 519, 523, 527, 531, 535, 539, 543, 547, 551, 555, 559, 563, 567, 571, 575, 579, 583, 587, 591, 595, 599, 603, 607, 611, 615, 619, 623, 627, 631, 635, 639, 643, 647, 651, 655, 659, 663, 667, 671, 675, 679, 683, 687, 691, 695, 699, 703, 707, 711, 715, 719, 723, 727, 731, 735, 739, 743, 747, 751, 755, 759, 763, 767, 771, 775, 779, 783, 787, 791, 795, 799, 803, 807, 884, 888, 892, 896, 900, 904, 908, 912, 916, 920, 924, 928, 932, 936, 940, 944, 948, 952, 956, 960, 964, 968, 972, 976, 980, 984, 988, 992, 996, 1000, 1004, 1008, 1012, 1016, 1020, 1024, 1028, 1032, 1036, 1040, 1044 and 1048.

6. The isolated binding agent according to claim 1, wherein said first and said second single domain antibody are covalently linked via a peptide, optionally wherein said peptide is between 3 and 50 amino acids in length, optionally wherein the linker comprises glycine and/or serine amino acid residues, optionally wherein the peptide has the formula (Gly4Ser)n, where n=1 to 20.

7. The isolated binding agent according to claim 1 further comprising one or more further binding molecules.

8. The isolated binding agent according to claim 7, wherein said binding molecule is an antibody or fragment thereof, or a single domain antibody, optionally wherein said binding molecule binds to either human PD-1, a different antigen, or an immunooncology target.

9. The isolated binding agent according to claim 1, wherein at least one single domain antibody is conjugated to a toxin, enzyme, radioisotope, half-life-extending moiety, therapeutic molecule or other chemical moiety, optionally
wherein said half-life-extending moiety is selected from the group consisting of an albumin binding moiety, a transferrin binding moiety, a polyethylene glycol molecule, a recombinant polyethylene glycol molecule, human serum albumin, a fragment of human serum albumin, and an albumin binding peptide or single domain antibody that binds to human serum albumin.

10. The isolated binding agent according to claim 1, wherein said first single domain antibody is located N-terminally and said second single domain antibody is located C-terminally, or wherein said first single domain antibody is located C-terminally and said second single domain antibody is located N-terminally.

11. A pharmaceutical composition comprising a binding agent according to claim 1 and a pharmaceutical carrier or a kit comprising the binding agent according to claim 1 or the pharmaceutical composition.

12. An isolated nucleic acid molecule comprising a nucleotide sequence encoding a binding agent according to claim 1.

13. A vector comprising a nucleic acid according to claim 12, or a host cell comprising a nucleic acid according to claim 12 or said vector, optionally a bacterial, yeast, viral or mammalian cell.

14. A method for producing a binding molecule according to claim 1 comprising expressing a nucleic acid encoding said binding molecule in a host cell and isolating the binding molecule from the host cell.

15. A method for detecting the presence of human PD-1 in a test sample comprising contacting said sample with a binding molecule according to claim 1 and at least one detectable label and detecting binding of said binding agent to human PD-1.

16. A combination comprising a) a first single domain antibody directed against a first epitope of human PD-1 and b) a second single domain antibody directed against a second epitope of human PD-1, wherein said first single domain antibody does not block the interaction of human PD-1 with human PD-L1 and/or PD-L2, and wherein said second single domain antibody blocks the interaction of human PD-1 with human PD-L1 and/or PD-L2, wherein said first single domain antibody binds to an epitope comprising amino acid residues 33-NPPTFS-38 (SEQ ID NO: 1095), 54-CSFSNTSESFVLNW-67 (SEQ ID NO: 1096) and 101-PNGRDFHMSV-110 (SEQ ID NO: 1097) or comprising amino acid residues 60-SESFVLNWYRMS-71 (SEQ ID NO: 1098), 90-GQDCRFRVT-98 (SEQ ID NO: 1099) and 104-RDFHMSVVRAR-114 (SEQ ID NO: 1110).

* * * * *

UNITED STATES PATENT AND TRADEMARK OFFICE
CERTIFICATE OF CORRECTION

| | |
|---|---|
| PATENT NO. | : 11,312,771 B2 |
| APPLICATION NO. | : 16/475599 |
| DATED | : April 26, 2022 |
| INVENTOR(S) | : Carolyn Edwards et al. |

It is certified that error appears in the above-identified patent and that said Letters Patent is hereby corrected as shown below:

In the Claims

In Claim 7, Column 106, Line 7, delete "further".

Signed and Sealed this
Twentieth Day of December, 2022

*Katherine Kelly Vidal*

Katherine Kelly Vidal
*Director of the United States Patent and Trademark Office*